US012781209B2

(12) United States Patent
Odate et al.

(10) Patent No.: US 12,781,209 B2
(45) **Date of Patent: *Nov. 3, 2026**

(54) COMPOSITIONS AND METHODS FOR KALLIKREIN (KLKB1) GENE EDITING

(71) Applicant: Intellia Therapeutics, Inc., Cambridge, MA (US)

(72) Inventors: Shobu Odate, Arlington, MA (US); Jessica Lynn Seitzer, Windham, NH (US)

(73) Assignee: Intellia Therapeutics, Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 19/327,529

(22) Filed: Sep. 12, 2025

(65) Prior Publication Data

US 2026/0125661 A1 May 7, 2026

Related U.S. Application Data

(60) Division of application No. 17/882,099, filed on Aug. 5, 2022, now abandoned, which is a continuation of application No. PCT/US2021/016730, filed on Feb. 5, 2021.

(60) Provisional application No. 63/019,076, filed on May 1, 2020, provisional application No. 62/981,965, filed on Feb. 26, 2020, provisional application No. 62/971,906, filed on Feb. 7, 2020.

(51) Int. Cl.

| | |
|---|---|
| ***C12N 9/22*** | (2006.01) |
| ***A61P 43/00*** | (2006.01) |
| ***C12N 15/10*** | (2006.01) |

(52) U.S. Cl.

CPC ................ *C12N 9/22* (2013.01); *A61P 43/00* (2018.01); *C12N 15/102* (2013.01); *C12N 2310/20* (2017.05); *C12N 2310/32* (2013.01)

(58) Field of Classification Search

None

See application file for complete search history.

(56) References Cited

U.S. PATENT DOCUMENTS

| | | | |
|---|---|---|---|
| 5,378,825 | A | 1/1995 | Cook et al. |
| 5,585,481 | A | 12/1996 | Arnold, Jr. et al. |
| 8,889,356 | B2 | 11/2014 | Zhang |
| 9,023,649 | B2 | 5/2015 | Mali et al. |
| 9,970,024 | B2 | 5/2018 | Church et al. |
| 2009/0286852 | A1 | 11/2009 | Kariko et al. |
| 2014/0186958 | A1 | 7/2014 | Zhang et al. |
| 2014/0213631 | A1 | 7/2014 | Bhattacharjee et al. |
| 2015/0166980 | A1 | 6/2015 | Liu et al. |
| 2016/0312198 | A1 | 10/2016 | Joung et al. |
| 2016/0312199 | A1 | 10/2016 | Joung et al. |
| 2017/0002359 | A1 | 1/2017 | Freier et al. |
| 2017/0183661 | A1 | 6/2017 | Prakash et al. |
| 2017/0260547 | A1 | 9/2017 | Dombrowski et al. |
| 2018/0064827 | A1 * | 3/2018 | Conway ............... C12N 9/6424 |
| 2018/0339004 | A1 | 11/2018 | Greenberg et al. |
| 2019/0100752 | A1 | 4/2019 | Caplan et al. |

FOREIGN PATENT DOCUMENTS

| | | | |
|---|---|---|---|
| WO | 1993013121 | A1 | 7/1993 |
| WO | 1995032305 | A1 | 11/1995 |
| WO | 2013003808 | A1 | 1/2013 |
| WO | 2013188876 | A2 | 12/2013 |
| WO | 2015031679 | A2 | 3/2015 |
| WO | 2015095340 | A1 | 6/2015 |
| WO | 2015168532 | A2 | 11/2015 |
| WO | 2015200555 | A2 | 12/2015 |
| WO | 2016010840 | A1 | 1/2016 |
| WO | 2016083820 | A1 | 6/2016 |
| WO | 2016179342 | A2 | 11/2016 |
| WO | 2017059178 | A1 | 4/2017 |
| WO | 2017136794 | A1 | 8/2017 |
| WO | 2017173054 | A1 | 10/2017 |
| WO | 2018107028 | A1 | 6/2018 |
| WO | 2019010342 | A1 | 1/2019 |
| WO | 2019023483 | A1 | 1/2019 |
| WO | 2019067910 | A1 | 4/2019 |
| WO | 2019067992 | A1 | 4/2019 |
| WO | 2019138354 | A1 | 7/2019 |
| WO | 2019237069 | A1 | 12/2019 |
| WO | 2021028645 | A1 | 2/2021 |
| WO | 2021092513 | A1 | 5/2021 |
| WO | 2021158858 | A1 | 8/2021 |

OTHER PUBLICATIONS

Finn et al. plus supplemental. A Single Administration of CRISPR/Cas9 Lipid Nanoparticles Achieves Robust and Persistent In Vivo Genome Editing. 2018. Cell Reports 22, 2227-2235. (Year: 2018).*

Yeadon. Pros and Cons of ZNFs, TALENs, and CRISPR/Cas. 2014. Blog Post. Accessed via the WayBack Machine at web.archive.org/web/20161011005545/https://www.jax.org/news-and-insights/jax-blog/2014/march/pros-and-cons-of-znfs-talens-and-crispr-cas. (Year: 2014).*

Longhurst, H. et al. "CRISPR-Cas9 In Vivo Gene Editing of KLKB1 for Hereditary Angioedema" NEJM 390(5):432-441, Feb. 1, 2024.

Longhurst, H. et al. "In vivo CRISPR/Cas9 editing of KLKB1 in patients with HAE" Session V: Bradykinin Symposium, Berlin, Germany Sep. 16, 2022, Clinical Trial Registration # NCT05120830.

(Continued)

*Primary Examiner* — Brian Whiteman

*Assistant Examiner* — Amanda M Zahorik

(74) *Attorney, Agent, or Firm* — McNeill PLLC

(57) ABSTRACT

Compositions and methods for editing, e.g., introducing double-stranded breaks, within the KLKB1 gene are provided. Compositions and methods for treating subjects having hereditary angioedema (HAE), are provided.

30 Claims, 34 Drawing Sheets

Specification includes a Sequence Listing.

(56) References Cited

OTHER PUBLICATIONS

Longhurst, H. et al. "Transient exposure to NTLA-2002, an investigational CRISPR/Cas9-based gene editing therapy, leads to durable pharmacodynamic responses and attack control in patients with hereditary angioedema" 13th C1 Inhibitor Deficiency and Angioedema Workshop, May 6, 2023, Clinical Trial Registration # NCT05120830.
Makarova, et al., "An updated evolutionary classification of CRISPR-Cas systems" Nat Rev Microbiol, 13(11): 722-36 (2015).
Makarova, et al., "Evolution and classification of the CRISPR-Cas systems" Nat. Rev. Microbiol. 9:467-477 (2011).
Mali et al., "CAS9 transcriptional activators for target specificity screening and paired nickases for cooperative genome engineering," Nat. Biotechnol. 31:833-8 (2013).
Mali, P et al. RNA-guided human genome engineering via Cas9. Science. Feb. 15, 2013;339(6121):823-6. doi: 10.1126/science.1232033. Epub Jan. 3, 2013. PMID: 23287722; PMCID: PMC3712628. (Year: 2013).
Mao, X. and Shuman, S. "Intrinsic RNA (guanine-7) methyltransferase activity of the vaccinia virus capping enzyme D1 subunit is stimulated by the D12 subunit. Identification of amino acid residues in the D1 protein required for subunit association and methyl group transfer" J. Biol. Chem. 269(39): 24472-24479 (1994).
Mohr SE, et al. "CRISPR guide RNA design for research applications". FEBS J. Sep. 2016;283(17):3232-8.
Nair et al., "A Simple Practice Guide for Dose Conversion Between Animals and Human", Journal of Basic and Clinical Pharmacy, vol. 7, No. 2, (2016), pp. 27-31.
NCBI Accession No. Q99ZW2, created Jul. 11, 2012 (annotation updated Mar. 27, 2024)—14 pages.
NCBI Accession Q99ZW2.1 CRISPR Cas9 nuclease (Year: 2015).
NCBI GenBank Reference Sequence NC_000004.12 (Year: 2014).
NCBI Reference Sequence: NG_012095.2. *Homo sapiens* kallikrein B, plasma (Fletcher factor) 1 (KLKB1), RefSeqGene on chromosome 4. First public release Feb. 26, 2014.
Peacock et al., "Chemical modification of siRNA bases to probe and enhance RNA interference" J Org Chem. 76(18): 7295-7300 (2011).
Perez-Pinera et al., "RNA-guided gene activation by CRISPR-Cas9-based transcription factors," Nat. Methods 10:973-6 (2013).
Qi et al., "Repurposing CRISPR as an RNA-guided platform for sequence-specific control of gene expression," Cell 152:1173-83 (2013).
Schmitz, C. et al. "Leveraging uncertainty quantification to optimise CRISPR guide RNA selection" bioRxiv, Feb. 2024; doi: https://doi.org/10.1101/2024.02.01.578527.
Seitzer, J. "CRISPR/Cas9-Mediated Liver Gene Knockout of KLKB1 to Treat Hereditary Angioedema" 23rd Annual Meeting of the American Society of Gene and Cell Therapy, May 15, 2020, downloaded at https://www.intelliatx.com/ wp-content/uploads/ASGCT-NTLA-HAE-JSeitzer-05.15.2020.pdf.
Seitzer, J. "NTLA-2002: CRISPR/Cas9-Mediated Gene Knockout of KLKB1 for Hereditary Angioedema" 2021 AAAAi Annual Meeting, Feb. 27, 2021, dowloaded at https://www.intelliatx.com/wp-content/uploads/AAAAi_2021_NTLA_HAE_27Feb2021.pdf.
Shmakov et al., "Discovery and Functional Characterization of Diverse Class 2 CRISPR-Cas Systems" Molecular Cell, 60(3):385-397 (2015).
Stepinski et al., (2001) "Synthesis and properties of mRNAs containing the novel 'anti-reverse' cap analogs 7-methyl (3'-O-methyl)GpppG and 7-methyl(3'deoxy)GpppG," RNA 7: 1486-1495.
Suffritti C, et al. "High-molecular weight kininogen cleavage correlates with disease states in the bradykinin-mediated angioedema due to hereditary C1-inhibitor deficiency" Clin Exp Allergy 2014;44: 1503-14.
Torenvliet-Berruti, B., International Search Report and Written Opinion issued in PCT/US2021/016730 on Feb. 5, 2021, 11 pages.
Tsai et al., "GUIDE-Seq Enables Genome-wide Profiling of Off-target Cleavage by CRISPR-Cas Nucleases," Nature Biotechnology 33, 187-197; 2015.
UniProt Accession No. Q99ZW2.1 (Year: 2015).
Unniyampurath et al. "RNA Interference in the Age of CRISPR: Will CRISPR Interfere with RNAi?" Int. J. Mol. Sci. 2016, 17(3), 291. (2016).
U.S. Appl. No. 18/362,675, Inventors:S. Odate and J.L. Seitzer filed Jul. 31, 2023.
Vester and Wengel, "LNA (locked nucleic acid): high-affinity targeting of complementary RNA and DNA" 2004, Biochemistry 43(42):13233-41.
Walsh et al. "CRISPR/Cas9 editing by NTLA-2002 remains durable in huKLKB1 mice following partial hepatectomy" poster #507, Feb. 28, 2022, downloaded at https://www.intelliatx.com/wp-content/uploads/AAAAi-Scientific-Poster_01.5_Final.pdf.
Walsh et al., "CRISPR/Cas9-Mediated KLKBI Gene Editing and Serum Kallikrein Reduction by NTLA-2002 Remains Durable in Humanized Mice Following Liver Regeneration After Partial Hepatectomy", Journal of Allergy and Clinical Immunology, vol. 149, No. 2, (2022), Abstract 507.
Wu, Y., et al. Highly efficient therapeutic gene editing of human hematopoietic stem cells. Nat Med 25, 776-783 (2019). https://doi.org/10.1038/s41591-019-0401-y (Year: 2019).
Zetsche et al. "Cpf1 is a single RNA-guided endonuclease of a class 2 CRISPR-Cas system" (2015) Cell Oct. 22:163 (3): 759-771.
Zuraw, B. L. "Hereditary Angioedema" N Engl J Med, 359(10):1027-1036 (2008).
Abbas, et al. "Structure of human IFIT1 with capped RNA reveals adaptable mRNA binding and mechanisms for sensing N1 and N2 ribose 2'-O methylations" Proc Natl Acad Sci USA 114(11):E2106-E2115 (2017).
Adams et al., ed., The Biochemistry of the Nucleic Acids 5-36, 11th ed., 1992.
Anders et al., "Structural basis of PAM-dependent target DNA recognition by the Cas9 endonuclease" Nature. Sep. 25, 2014; 513(7519): 569-573 (Year: 2014).
Aygören-Pürsün, et al. "Prophylaxis of hereditary angioedema attacks: A randomized trial of oral plasma kallikrein inhibition with avoralstat" J Allergy Clin Immunol 2016; 138: 934-936.
Aygören-Pürsun, et al., "Oral Plasma Kallikrein Inhibitor for Prophylaxis in Hereditary Angioedema" N Engl J Med 2018; 379:352-362.
Banerji A, et al. "Inhibiting plasma kallikrein for hereditary angioedema prophylaxis" N Engl J Med 2017;376:717-28.
Behlke, "Chemical modification of siRNAs for in vivo use" Oligonucleotides 18:305-320 (2008).
Bhattacharjee G, et al. "Inhibition of vascular permeability by antisense-mediated inhibition of plasma kallikrein and coagulation factor 12" Nucleic Acid Ther. Jun. 2013;23(3):175-87.
Briner, A.E. et al., "Guide RNA functional modules direct Cas9 activity and orthogonality" Molecular Cell 56:333-339 (2014).
Cameron et al., "Mapping the genomic landscape of CRISPR-Cas9 cleavage" Nature Methods (6) 600-606; 2017.
Chen et al. "Fusion protein linkers: property, design and functionality" Adv Drug Deliv Rev. Oct. 15, 2013; 65(10): 1357-1369. doi:10.1016/j.addr.2012.09.039. (Year: 2012).
Cohn, D. et al."Results From a Phase 2, Randomized, Placebo-Controlled Trialof CRISPR-Based Therapy NTLA-2002 for HereditaryAngioedema" Presented at the American College of Allergy, Asthma & Immunology (ACAAI) 2024 Annual Scientific Meeting, Oct. 24-28, 2024, Boston, Massachusetts.
Cohn, D. et al. "CRISPR-Based Therapy for Hereditary Angioedema" NEJM, DOI: 10.1056/NEJMoa2405734, Oct. 24, 2024.
Cohn, D. et al. "Updated Safety and Efficacy of NTLA-2002, a CRISPR/CAS9-Based Gene Editing Therapy Targeting KLKB1, in a Phase 1 Study of Patients With Hereditary Angioedema" European Academy of Allergy & Clinical Immunology Annual Meeting, Jun. 11, 2023, Clinical Trial Registration # NCT05120830, poster.
Defendi et al., "Enzymatic assays for the diagnosis of bradykinin-dependent angioedema" PLoS One 2013;8:e70140.
Eguchi A, et al. Optimization of nuclear localization signal for nuclear transport of DNA-encapsulating particles. J Control Release.

(56) References Cited

OTHER PUBLICATIONS

Jun. 2, 2005; 104(3):507-19. doi: 10.1016/j.jconrel .2005.02.019. Epub Apr. 21, 2005. PMID: 15911050. (Year: 2005).
Ferreira, et al., "The detection and estimation of bradykinin in the circulating blood" Br. J. Pharmac. Chemother. (1967), 29, 367-377.
Ferrone, J.D. et al. "IONIS-PKKRx a Novel Antisense Inhibitor of Prekallikrein and Bradykinin Production" Nucleic Acid Ther. 2019;29(2):82-91.
Fijen et al., "Current and Prospective Targets of Pharmacologic Treatment of Hereditary Angioedema Types 1 and 2", Clinical Reviews in Allergy and Immunology, vol. 61, No. 1, (2021 ), pp. 66-76.
Finn, Jonathan D. et al. "A Single Administration of CRISPR/Cas9 Lipid Nanoparticles Achieves Robust and Persistent In Vivo Genome Editing", Cell Reports, vol. 22, Issue 9, 2018, pp. 2227-2235, 2018.02.014.
Frock et al. "Genome-wide detection of DNA double-stranded breasks induced by engineered nucleases" Nature Biotechnology, 33(2):179-188 (2015).
Gagnon et al. "Efficient Mutagenesis by Cas9 Protein-Mediated Oligonucleotide Insertion and Large-Scale Assessment of Single-Guide RNAs". (2014) PLoS ONE 9(5): e98186. Supplemental Protocols, 21 pgs.
Gagnon et al. "Efficient Mutagenesis by Cas9 Protein-Mediated Oligonucleotide Insertion and Large-Scale Assessment of Single-Guide RNAs". (2014) PLoS ONE 9(5): e98186.
Gen Bank Accession No. CB162532.1, dated Jul. 20, 2010.
Ghidini et al., "An RNA modification with remarkable resistance to RNase A" Chem. Commun., 2013, 49(79): 9036-8.
Gilbert et al., "CRISPR-mediated modular RNA-guided regulation of transcription in eukaryotes," Cell 154:442-51 (2013).
Guo, P. and Moss, B., "Interaction and mutual stabilization of the two subunits of vaccinia virus mRNA capping enzyme coexpressed in *Escherichia coli*" Proc. Natl. Acad. Sci. USA 87(11): 4023-4027 (1990).
Hsu et al. "DNA targeting specificity of RNA-guided Cas9 nucleases" Nature Biotechnology vol. 31, pp. 827-832 (2013) (Year: 2013).
Inouye, S. et al. Codon optimization of genes for efficient protein expression in mammalian cells by selection of only preferred human codons. Protein Expr Purif. May 2015; 109:47-54. doi: 10.1016/j.pep.2015.02.002. Epub Feb. 7, 2015. PMID: 25665506. (Year: 2015).
Intellia Therapeutics, Inc. Press Release "Intellia Presents Positive Results from the Phase 2 Study of NTLA-2002, an Investigational In Vivo CRISPR Gene Editing Treatment for Hereditary Angioedema (HAE)" Oct. 24, 2024, downloaded at https://ir.intelliatx.com/news-releases/news-release-details/intellia-presents-positive-results-phase-2-study-ntla-2002.
Intellia Therapeutics, Inc. Press Release "Intellia Therapeutics Announces Initiation of HAELO Phase 3 Study of NTLA-2002, an Investigational In Vivo CRISPR Gene Editing Treatment for Hereditary Angioedema (HAE)Oct. 7, 2024" downloaded at https://ir.intelliatx.com/news-releases/news-release-details/intellia-therapeutics-announces-initiation-haelo-phase-3-study.
Intellia Therapeutics, Inc. Press Release "Intellia Therapeutics Announces New Positive Clinical Data from Phase 1 Study of NTLA-2002, an Investigational In Vivo CRISPR Genome Editing Treatment for Hereditary Angioedema (HAE)" Jun. 11, 2023, downloaded at https://ir.intelliatx.com/news-releases/news-release-details/intellia-therapeutics-announces-new-positive-clinical-data-phase.
Intellia Therapeutics, Inc. Press Release "Intellia Therapeutics Announces Positive Long-Term Data from Ongoing Phase 1 Study of NTLA-2002, an Investigational In Vivo CRISPR Gene Editing Treatment for Hereditary Angioedema (HAE)" Jun. 2, 2024, downloaded at https://ir.intelliatx.com/news-releases/news-release-details/intellia-therapeutics-announces-positive-long-term-data-ongoing.
Intellia Therapeutics, Inc. Press Release "Intellia Therapeutics Announces Publication of Positive Interim Phase 1 Data for NTLA-2002 in Patients with Hereditary Angioedema in the New England Journal of Medicine" Jan. 31, 2024, downloaded at https://ir.intelliatx.com/news-releases/news-release-details/intellia-therapeutics-announces-publication-positive-interim.
Intellia Therapeutics, Inc. Press Release "Intellia Therapeutics Announces Second Quarter 2024 Financial Results and Highlights Recent Company Progress" Aug. 8, 2024, downloaded at https://ir.intelliatx.com/news-releases/news-release-details/intellia-therapeutics-announces-second-quarter-2024-financial.
Intellia Therapeutics, Inc. Press Release "Intellia Therapeutics Announces Third Quarter 2024 Financial Results and Highlights Recent Company Progress" Nov. 7, 2024, downloaded at https://ir.intelliatx.com/news-releases/news-release-details/intellia-therapeutics-announces-third-quarter-2024-financial.
Intellia Therapeutics, Inc. Press Release "Intellia Therapeutics to Present Data from the Phase 2 Study of NTLA-2002 for the Treatment of Hereditary Angioedema (HAE) at the 2024 ACAAI Annual Scientific Meeting"Sep. 12, 2024, downloaded at https://ir.intelliatx.com/news-releases/news-release-details/intellia-therapeutics-present-data-phase-2-study-ntla-2002.
Intellia Therapeutics, Inc. Press Release "Intellia Therapeutics to Present Updated Data from Phase 1/2 Study of NTLA-2002 for the Treatment of Hereditary Angioedema (HAE) at the EAACI Congress 2024" Apr. 29, 2024, downloaded at https://ir.intelliatx.com/news-releases/news-release-details/intellia-therapeutics-present-updated-data-phase-12-study-ntla.
Intellia Therapeutics, Inc. Press Release "Intellia Therapeutics to Present Updated Interim Data from Ongoing Phase 1/2 Study of NTLA-2002 for the Treatment of Hereditary Angioedema (HAE) at the EAACI Hybrid Congress 2023" May 31, 2023, downloaded at https://ir.intelliatx.com/news-releases/news-release-details/intellia-therapeutics-present-updated-interim-data-ongoing-phase.
Intellia Therapeutics, Inc., Press Release, "Intellia Therapeutics Highlights Recent Progress and Anticipated 2020 Milestones," Jan. 9, 2020, downloaded at https://ir.intelliatx.com/news-releases/news-release-details/intellia-therapeutics-highlights-recent-progress-and-anticipated.
Juffern, D. et al., International Search Report and Written Opinion for International Application No. PCT/US2023/069753, mailed Oct. 20, 2023, 12 pages.
Katibah, et al. "Broad and adaptable RNA structure recognition by the human interferon-induced tetratricopeptide repeat protein IFIT5" Proc Natl Acad Sci USA 111(33):12025-30 (2014).
Kazemian, et al., "Lipid-Nanoparticle-Based Delivery of CRISPR/Cas9 Genome-Editing Components", Molecular Pharmaceutics, vol. 19, No. 6, (2022), pp. 1669-1686.
Ku et al., "Chemical and structural modifications of RNAi therapeutics" Adv. Drug Delivery Reviews 104: 16-28 (2016).
Leonard, J. et al. "NTLA-2002 Interim Clinical Data Update from Ongoing First-in-Human Study" Jun. 12, 2023 presentation, Intellia Therapeutics, Inc.
Leonard, J. et al. "NTLA-2002 Long-Term Phase 1 Data Update from the Ongoing Phase 1/2 Study" Jun. 3, 2024 presentation, Intellia Therapeutics, Inc.
Leonard, J. et al. "Results from Phase 2 Study of NTLA-2002 for Hereditary Angioedema" Oct. 24, 2024 presentation, Intellia Therapeutics, Inc.
Liu, G. et al. "Computational approaches for effective CRISPR guide RNA design and evaluation" Computational and Structural Biotechnology Journal 18 (2020) 35-44, https://doi.org/10.1016/j.csbj.2019.11.006.
Longhurst, H. et al. "In vivo CRISPR/Cas9 editing of KLKB1 in patients with Hereditary Angioedema: A First-in-Human Study" American College of Allergy, Asthma & Immunology 2022 Annual Scientific Meeting Nov. 12, 2022, Clinical Trial Registration # NCT05120830.
Longhurst, H. et al. "CRISPR-Based Gene Editing of KLKB1 Resulted in Long Term Plasma Kallikrein Protein Reduction and Decreased Attack Rate in Patients With Hereditary Angioedema: Updated Results From a Phase 1 Study" Presented at the EAACI Congress 2024, May 31-Jun. 3, 2024, Valencia, Spain.

(56) References Cited

OTHER PUBLICATIONS

GenBank Accession No. HQ258334. Synthetic construct *Homo sapiens* clone IMAGE: 100072643 kallikrein B, plasma (Fletcher factor) 1 (KLKB1) (KLKB1) gene, encodes complete protein. Jul. 25, 2016. (Year: 2016).

* cited by examiner

Scaffold Y/A (SEQ ID NO: 201)

(SEQ ID NO: 401)

COMPOSITIONS AND METHODS FOR KALLIKREIN (KLKB1) GENE EDITING

CROSS-REFERENCE TO RELATED APPLICATIONS

This patent application is a divisional application of U.S. application Ser. No. 17/882,099, filed Aug. 5, 2022, which is a continuation of International Application No. PCT/US2021/016730, filed Feb. 5, 2021, which claims priority to U.S. Provisional Patent Application No. 62/971,906, filed Feb. 7, 2020; U.S. Provisional Patent Application No. 62/981,965, filed Feb. 26, 2020; and U.S. Provisional Patent Application No. 63/019,076, filed May 1, 2020, the contents of each of which are incorporated herein by reference in their entirety for all purposes.

INCORPORATION-BY-REFERENCE OF MATERIAL SUBMITTED ON A READ-ONLY OPTICAL DISC AS AN XML FILE VIA THE PATENT ELECTRONIC SYSTEM

The instant application contains a Sequence Listing which has been submitted electronically in XML format and is hereby incorporated by reference in its entirety. Said XML copy, created on Nov. 18, 2024, is named "01155-0031-00US.xml" and is 2,202,442 bytes in size.

BACKGROUND

Hereditary angioedema (HAE) affects one in 50,000 people and contributes to 15,000 to 30,000 emergency room visits per year. HAE is a rare autosomal, dominantly inherited blood disorder characterized by recurrent episodes of severe swelling (angioedema). The most common areas of the body to develop swelling are the limbs, face, GI tract, and airway. Minor trauma or stress may trigger an attack but swelling often occurs without a known trigger. Episodes involving the intestinal tract cause severe abdominal pain, nausea, and vomiting. Swelling in the airway can restrict breathing and lead to life-threatening obstruction of the airway or asphyxiation. Symptoms of HAE typically begin in childhood and worsen during puberty. On average, untreated individuals have an attack every 1 to 2 weeks, and most episodes last for about 3 to 4 days. There are three types of hereditary angioedema, called types I, II, and III, and the different types have similar signs and symptoms.

Hereditary angioedema stems from excess bradykinin in the blood promoting vascular permeability and episodes of swelling. Most patients with HAE have a C1 inhibitor (also called C1 esterase inhibitor or C1-INH) protein deficiency. In the absence of C1-INH, bradykinin levels can rise, initiate vascular leakage, and cause swelling attacks. Its production is controlled via the kallikrein-kinin (contact) pathway which is endogenously inhibited by C1-INH. Bradykinin peptide is formed when high-molecular weight kininogen (HMWK) is cleaved by plasma kallikrein (pKal), an activated form of the protein prekallikrein. Prekallikrein is encoded by KLKB1 and is also called KLKB1 protein. KLKB1 protein is produced in the liver and secreted into plasma where it can be activated by factor XIIa. Once KLKB1 is activated, pKal can increase bradykinin levels. An excess of bradykinin in the blood leads to fluid leakage through the walls of blood vessels into body tissues. Excessive accumulation of fluids in body tissues causes the episodes of swelling seen in individuals with HAE.

Several drugs targeting the kallikrein-kinin pathway have been developed, including C1 esterase inhibitors (Berinert®, Cinryze®), recombinant C1-INH replacement therapy (rhC1INH; conestat alfa (Rhucin®, Ruconest®)), and bradykinin receptor antagonist (Icatibant, Firazyr®). Approaches using kallikrein or prekallikrein (KLKB1) inhibitors also have been developed (ecallantide, Kalbitor®; lanadelumab, Takhzyro™).

BRIEF SUMMARY

The present disclosure provides compositions and methods using the CRISPR/Cas system to knock out the KLKB1 gene, thereby reducing the production of prekallikrein (KLKB1), reducing kallikrein, and reducing bradykinin production in subjects with HAE.

Accordingly, the following embodiments are provided. In some embodiments, the present invention provides compositions and methods using a guide RNA with an RNA-guided DNA binding agent such as the CRISPR/Cas system to substantially reduce or knockout expression of the KLKB1 gene, thereby substantially reducing or eliminating the production of bradykinin. The substantial reduction or elimination of the production of bradykinin through alteration of the KLKB1 gene can be a long-term or permanent treatment.

The following embodiments are provided herein.

Embodiment A1 is a guide RNA comprising:

a. a guide sequence comprising at least 95%, 90%, or 85% identity to a sequence selected from SEQ ID NOs: 15, 8, and 41;
b. a guide sequence comprising at least 17, 18, 19, or 20 contiguous nucleotides of a sequence selected from SEQ ID NOs: 15, 8, and 41; or
c. a guide sequence selected from SEQ ID NOs: 15, 8, and 41.

Embodiment A2 is the guide RNA of embodiment A1, further comprising the nucleotide sequence of SEQ ID NO: 202.

Embodiment A3 is the guide RNA of embodiment A1, wherein the guide RNA further comprises a nucleotide sequence selected from SEQ ID NO: 170, 171, 172, and 173 wherein the sequence of SEQ ID NO: 170, 171, 172, or 173 is 3' of the guide sequence.

Embodiment A4 is the guide RNA of any one of embodiments A1-A3, wherein the guide RNA further comprises a 3' tail.

Embodiment A5 is the guide RNA of any one of embodiments A1-A4, wherein the guide RNA comprises at least one modification.

Embodiment A6 is the guide RNA of embodiment A5, wherein the modification comprises a 5' end modification.

Embodiment A7 is the guide RNA of embodiment A5 or A6, wherein the modification comprises a 3' end modification.

Embodiment A8 is the guide RNA of any one of embodiments A1-A7, wherein the guide RNA comprises a modification in a hairpin region.

Embodiment A9 is the guide RNA of any one of embodiments A1-A8, wherein the modification comprises a 2'-O-methyl (2'-O-Me) modified nucleotide.

Embodiment A10 is the guide RNA of any one of embodiments A1-A9, wherein the modification comprises a phosphorothioate (PS) bond between nucleotides.

Embodiment A11 is the guide RNA of any one of embodiments A1-A10, wherein the modification comprises a 2'-fluor (2'F) modified nucleotide.

Embodiment A12 is the guide RNA of any one of embodiments A1 or A3-A11, further comprising the nucleotide sequence of SEQ ID NO: 171.

Embodiment A13 is the guide RNA of embodiment A12, modified according to the pattern of the nucleotide sequence of SEQ ID NO: 405.

Embodiment A14 is the guide RNA of any one of embodiments A1 or A3-A11, further comprising the nucleotide sequence of SEQ ID NO: 173.

Embodiment A15 is the guide RNA of embodiment A14, modified according to the pattern of SEQ ID NO: 248-255 or 450.

Embodiment A16 is the guide RNA of any one of embodiments A12-A15, wherein the guide sequence is SEQ ID NO: 15.

Embodiment A17 is the guide RNA of any one of embodiments A12-A15, wherein the guide sequence is SEQ ID NO: 8.

Embodiment A18 is the guide RNA of any one of embodiments A12-A15, wherein the guide sequence is SEQ ID NO: 41.

Embodiment A19 is the guide RNA of any one of embodiments A1 or A4-A11, wherein the guide RNA is modified according to the pattern of SEQ ID NO: 300, wherein the Ns are collectively the guide sequence of embodiment A1.

Embodiment A20 is the guide RNA of embodiment A16, wherein each N in SEQ ID NO: 300 is any natural or non-natural nucleotide.

Embodiment A21 is the guide RNA of embodiment A19, wherein the guide sequence is SEQ ID NO: 15 and the guide RNA is modified according to mG*mG*mA*UUGCGUAUGGGACACAAGUUUUAGA mGmCmUmAmGmAmAmAmUmAmGmCAA GUUAAAAUAAGGCUAGUCCGUUAUCAmAmCmU-mUmGmAmAmAmAmAmGmUm GmGmCmAm-CmCmGmAmGmUmCmGmGmUmGmCm U*mU*mU*mU (SEQ ID NO: 603), wherein "mA," "mC," "mU," or "mG" denote a nucleotide that has been modified with 2'-O-Me, and a * denotes a phosphorothioate bond.

Embodiment A22 is the guide RNA of embodiment A19, wherein the guide sequence is SEQ ID NO: 8 and the guide RNA is modified according to mU*mA*mC*CCGGGAGUUGACUUUGGGUUUUAGA mGmCmUmAmGmAmAmAmU mAmGmCAAGUUAAAAUAAGGCUAGUCCGUUAU-CAmAmCmUmUmGmAmAmAm AmAmG-mUmGmGmCmAmCmCmGmAmGmUmCmGm GmUmGmCmU*mU*mU*mU (SEQ ID NO: 604), wherein "mA," "mC," "mU," or "mG" denote a nucleotide that has been modified with 2'-O-Me, and a * denotes a phosphorothioate bond.

Embodiment A23 is the guide RNA of embodiment A19, wherein the guide sequence is SEQ ID NO: 41 and the guide RNA is modified according to mU*mA*mU*UAUCAAAUCACAUUACCGUUUUAGA mGmCmUmAmGmAmAmAmU mAmGmCAAGUUAAAAUAAGGCUAGUCCGUUAU-CAmAmCmUmUmGmAmAmAm AmAmG-mUmGmGmCmAmCmCmGmAmGmUmCmGm GmUmGmCmU*mU*mU*mU (SEQ ID NO: 605), wherein "mA," "mC," "mU," or "mG" denote a nucleotide that has been modified with 2'-O-Me, and a * denotes a phosphorothioate bond.

Embodiment A24 is a composition comprising a guide RNA of any one of embodiments A1-A23.

Embodiment A25 is a composition of embodiment A24, further comprising an RNA-guided DNA binding agent or nucleic acid encoding an RNA-guided DNA binding agent.

Embodiment A26 is the composition of embodiment A25, wherein the nucleic acid encoding an RNA-guided DNA binding agent comprises an mRNA comprising an open reading frame (ORF) encoding an RNA-guided DNA binding agent.

Embodiment A27 is the composition of embodiment A25 or A26, wherein the RNA-guided DNA binding agent is Cas9.

Embodiment A28 is the composition of embodiment A27, wherein the Cas9 is *S. pyogenes* Cas9.

Embodiment A29 is the composition of any one of embodiments A26-A28, wherein the ORF is a modified ORF.

Embodiment A30 is the composition of any one of embodiments A24-A29, further comprising a pharmaceutical excipient.

Embodiment A31 is the composition of any one of embodiments A24-A30, wherein the guide RNA is associated with a lipid nanoparticle (LNP).

Embodiment A32 is the composition of embodiment A31, wherein the LNP comprises a cationic lipid.

Embodiment A33 is the composition of embodiment A32, wherein the cationic lipid is (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate.

Embodiment A34 is the composition of any one of embodiments A31-A33, wherein the LNP comprises (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate, DSPC, cholesterol, and PEG2k-DMG.

Embodiment A35 is a pharmaceutical composition comprising a guide RNA of any one of embodiments A1-A23 or a composition of any one of embodiments A24-A34.

Embodiment A36 is a pharmaceutical composition comprising or use of a guide RNA of any one of embodiments A1-A23 or composition of any one of embodiments A24-A34 for inducing a double-stranded break or a single-stranded break within a KLKB1 gene in a cell or reducing expression of KLKB1 in a cell.

Embodiment A37 is the pharmaceutical composition or use of embodiment A36, for reducing expression of the KLKB1 gene in a cell or subject.

Embodiment A38 is a pharmaceutical composition comprising or use of a guide RNA of any one of embodiments A1-A23 or composition of any one of embodiments A24-A34 for treating a subject having hereditary angioedema (HAE).

Embodiment A39 is the pharmaceutical composition or use of embodiment A38, comprising reducing the frequency and/or severity of HAE attacks.

Embodiment A40 is a pharmaceutical composition comprising or use of a guide RNA of any one of embodiments A1-A23 or composition of any one of embodiments A24-A34 for treating or preventing angioedema associated with HAE, bradykinin production and accumulation, bradykinin-induced swelling, angioedema obstruction of the airway, or asphyxiation.

Embodiment A41 is a pharmaceutical composition or use of a guide RNA of any one of embodiments A1-A23 or composition of any one of embodiments A24-A34 for reducing total plasma kallikrein activity or reducing prekallikrein and/or kallikrein levels in a subject.

Embodiment A42 is the pharmaceutical composition or use of embodiment A41, wherein the total plasma kallikrein activity is reduced by more than 60%.

Embodiment A43 is a method for inducing a double-stranded break or a single-stranded break within a KLKB1 gene in a cell or reducing expression of KLKB1 in a cell comprising contacting a cell with a guide RNA of any one of embodiments A1-A23 or a composition of any one of embodiments A24-A34.

Embodiment A44 is the method of embodiment A43, wherein the cell is in a subject.

Embodiment A45 is a method of treating a subject having hereditary angioedema (HAE) comprising administering a guide RNA of any one of embodiments A1-A23 or a composition of any one of embodiments A24-34 thereby treating the subject.

Embodiment A46 is the method of embodiment A45, wherein treating the subject comprises reducing the frequency and/or severity of HAE attacks.

Embodiment A47 is a method of treating or preventing angioedema associated with HAE, bradykinin production and accumulation, bradykinin-induced swelling, angioedema obstruction of the airway, or asphyxiation comprising administering to the subject a guide RNA of any one of embodiments A1-A23 or a composition of any one of embodiments A24-A34, thereby treating or preventing angioedema associated with HAE, bradykinin production and accumulation, bradykinin-induced swelling, angioedema obstruction of the airway, or asphyxiation in the subject.

Embodiment A48 is a method of reducing total plasma kallikrein activity in a subject comprising administrating a guide RNA of any one of embodiments A1-A23 or a composition of any one of embodiments A24-A34, thereby reducing total plasma kallikrein activity in a subject.

Embodiment A49 is the method of embodiment A48, wherein the total plasma kallikrein activity is reduced by more than 60% in the subject.

Embodiment A50 is the use of a guide RNA of any one of embodiments A1-A23 or a composition of any one of embodiments A24-A34 in the preparation of a medicament for practicing any of the methods of embodiments A43-A49.

Additional embodiments are provided herein.

Embodiment 1 is a method of inducing a double-stranded break (DSB) or a single-stranded break (SSB) within the KLKB1 gene, comprising delivering a composition to a cell, wherein the composition comprises:

- a. a guide RNA comprising
  - i. a guide sequence selected from SEQ ID NOs: 1-149; or
  - ii. at least 17, 18, 19, or 20 contiguous nucleotides of a sequence selected from SEQ ID NOs: 1-149; or
  - iii. a guide sequence that is at least 95%, 90%, or 85% identical to a sequence selected from SEQ ID NOs: 1-149; or
  - iv. a guide sequence comprising any one of SEQ ID NOs: 1, 7, 8, 15, 26, 27, 28, 41, 42, 46, 51, 52, 53, 56, 69, or 71; or
  - v. a guide sequence comprising any one of SEQ ID Nos: 8, 15, 41, 51, or 69; or
  - vi. a sequence that comprises 15 consecutive nucleotides plus-or-minus 10 nucleotides of a genomic coordinate listed in Table 1; or
  - vii. at least 17, 18, 19, or 20 contiguous nucleotides of a sequence selected from the sequences of (vi); or
  - viii. a guide sequence that is at least 95%, 90%, or 85% identical to a sequence selected from the sequences of (vi); and optionally
- b. an RNA-guided DNA binding agent or a nucleic acid encoding an RNA-guided DNA binding agent.

Embodiment 2 is a method of reducing the expression of the KLKB1 gene comprising delivering a composition to a cell, wherein the composition comprises:

- a. a guide RNA comprising
  - i. a guide sequence selected from SEQ ID NOs: 1-149; or
  - ii. at least 17, 18, 19, or 20 contiguous nucleotides of a sequence selected from SEQ ID NOs: 1-149; or
  - iii. a guide sequence that is at least 95%, 90%, or 85% identical to a sequence selected from SEQ ID NOs: 1-149; or
  - iv. a guide sequence comprising any one of SEQ ID NOs: 1, 7, 8, 15, 26, 27, 28, 41, 42, 46, 51, 52, 53, 56, 69, or 71; or
  - v. a guide sequence comprising any one of SEQ ID Nos: 8, 15, 41, 51, or 69; or
  - vi. a sequence that comprises 15 consecutive nucleotides plus-or-minus 10 nucleotides of a genomic coordinate listed in Table 1; or
  - vii. at least 17, 18, 19, or 20 contiguous nucleotides of a sequence selected from the sequences of (vi); or
  - viii. a guide sequence that is at least 95%, 90%, or 85% identical to a sequence selected from the sequences of (vi); and optionally
- b. an RNA-guided DNA binding agent or a nucleic acid encoding an RNA-guided DNA binding agent.

Embodiment 3 is a method of treating or preventing hereditary angioedema (HAE) comprising administering a composition to a subject in need thereof, wherein the composition comprises:

- a. a guide RNA comprising
  - i. a guide sequence selected from SEQ ID NOs: 1-149; or
  - ii. at least 17, 18, 19, or 20 contiguous nucleotides of a sequence selected from SEQ ID NOs: 1-149; or
  - iii. a guide sequence that is at least 95%, 90%, or 85% identical to a sequence selected from SEQ ID NOs: 1-149; or
  - iv. a guide sequence comprising any one of SEQ ID NOs: 1, 7, 8, 15, 26, 27, 28, 41, 42, 46, 51, 52, 53, 56, 69, or 71; or
  - v. a guide sequence comprising any one of SEQ ID Nos: 8, 15, 41, 51, or 69; or
  - vi. a sequence that comprises 15 consecutive nucleotides plus-or-minus 10 nucleotides of a genomic coordinate listed in Table 1; or
  - vii. at least 17, 18, 19, or 20 contiguous nucleotides of a sequence selected from the sequences of (vi); or
  - viii. a guide sequence that is at least 95%, 90%, or 85% identical to a sequence selected from the sequences of (vi); and optionally
- b. an RNA-guided DNA binding agent or nucleic acid encoding an RNA-guided DNA binding agent, thereby treating or preventing HAE.

Embodiment 4 is a method of treating or preventing angioedema caused by or associated with HAE comprising administering a composition to a subject in need thereof, wherein the composition comprises:

a. a guide RNA comprising
   i. a guide sequence selected from SEQ ID NOs: 1-149; or
   ii. at least 17, 18, 19, or 20 contiguous nucleotides of a sequence selected from SEQ ID NOs: 1-149; or
   iii. a guide sequence that is at least 95%, 90%, or 85% identical to a sequence selected from SEQ ID NOs: 1-149; or
   iv. a guide sequence comprising any one of SEQ ID NOs: 1, 7, 8, 15, 26, 27, 28, 41, 42, 46, 51, 52, 53, 56, 69, or 71; or
   v. a guide sequence comprising any one of SEQ ID Nos: 8, 15, 41, 51, or 69; or
   vi. a sequence that comprises 15 consecutive nucleotides plus-or-minus 10 nucleotides of a genomic coordinate listed in Table 1; or
   vii. at least 17, 18, 19, or 20 contiguous nucleotides of a sequence selected from the sequences of (vi); or
   viii. a guide sequence that is at least 95%, 90%, or 85% identical to a sequence selected from the sequences of (vi); and optionally
b. an RNA-guided DNA binding agent or nucleic acid encoding an RNA-guided DNA binding agent, thereby treating or preventing angioedema caused by or associated with HAE.

Embodiment 5 is a method of treating or preventing any one of bradykinin production and accumulation, bradykinin-induced swelling, angioedema obstruction of the airway, or asphyxiation comprising administering a composition to a subject in need thereof, wherein the composition comprises:

a. a guide RNA comprising
   i. a guide sequence selected from SEQ ID NOs: 1-149; or
   ii. at least 17, 18, 19, or 20 contiguous nucleotides of a sequence selected from SEQ ID NOs: 1-149; or
   iii. a guide sequence that is at least 95%, 90%, or 85% identical to a sequence selected from SEQ ID NOs: 1-149; or
   iv. a guide sequence comprising any one of SEQ ID NOs: 1, 7, 8, 15, 26, 27, 28, 41, 42, 46, 51, 52, 53, 56, 69, or 71; or
   v. a guide sequence comprising any one of SEQ ID Nos: 8, 15, 41, 51, or 69; or
   vi. a sequence that comprises 15 consecutive nucleotides plus-or-minus 10 nucleotides of a genomic coordinate listed in Table 1; or
   vii. at least 17, 18, 19, or 20 contiguous nucleotides of a sequence selected from the sequences of (vi); or
   viii. a guide sequence that is at least 95%, 90%, or 85% identical to a sequence selected from the sequences of (vi); and optionally
b. an RNA-guided DNA binding agent or nucleic acid encoding an RNA-guided DNA binding agent, thereby treating or preventing any one of bradykinin production and accumulation, bradykinin-induced swelling, angioedema obstruction of the airway, or asphyxiation.

Embodiment 6 is a method of reducing the frequency and/or severity of HAE attacks, comprising administering a composition to a subject in need thereof, wherein the composition comprises:

a. a guide RNA comprising
   i. a guide sequence selected from SEQ ID NOs: 1-149; or
   ii. at least 17, 18, 19, or 20 contiguous nucleotides of a sequence selected from SEQ ID NOs: 1-149; or
   iii. a guide sequence that is at least 95%, 90%, or 85% identical to a sequence selected from SEQ ID NOs: 1-149; or
   iv. a guide sequence comprising any one of SEQ ID NOs: 1, 7, 8, 15, 26, 27, 28, 41, 42, 46, 51, 52, 53, 56, 69, or 71; or
   v. a guide sequence comprising any one of SEQ ID Nos: 8, 15, 41, 51, or 69; or
   vi. a sequence that comprises 15 consecutive nucleotides plus-or-minus 10 nucleotides of a genomic coordinate listed in Table 1; or
   vii. at least 17, 18, 19, or 20 contiguous nucleotides of a sequence selected from the sequences of (vi); or
   viii. a guide sequence that is at least 95%, 90%, or 85% identical to a sequence selected from the sequences of (vi); and optionally
b. an RNA-guided DNA binding agent or nucleic acid encoding an RNA-guided DNA binding agent, thereby reducing the frequency and/or severity of HAE attacks.

Embodiment 7 is a method for reducing the frequency and/or severity of angioedema attacks, or achieving remission of angioedema attacks in a subject, comprising administering a composition to a subject in need thereof, wherein the composition comprises:

a. a guide RNA comprising
   i. a guide sequence selected from SEQ ID NOs: 1-149; or
   ii. at least 17, 18, 19, or 20 contiguous nucleotides of a sequence selected from SEQ ID NOs: 1-149; or
   iii. a guide sequence that is at least 95%, 90%, or 85% identical to a sequence selected from SEQ ID NOs: 1-149; or
   iv. a guide sequence comprising any one of SEQ ID NOs: 1, 7, 8, 15, 26, 27, 28, 41, 42, 46, 51, 52, 53, 56, 69, or 71; or
   v. a guide sequence comprising any one of SEQ ID Nos: 8, 15, 41, 51, or 69; or
   vi. a sequence that comprises 15 consecutive nucleotides plus-or-minus 10 nucleotides of a genomic coordinate listed in Table 1; or
   vii. at least 17, 18, 19, or 20 contiguous nucleotides of a sequence selected from the sequences of (vi); or
   viii. a guide sequence that is at least 95%, 90%, or 85% identical to a sequence selected from the sequences of (vi); and optionally
b. an RNA-guided DNA binding agent or nucleic acid encoding an RNA-guided DNA binding agent, thereby reducing the frequency and/or severity of angioedema attacks or achieving remission of angioedema attacks in a subject.

Embodiment 8 is a method of reducing total plasma kallikrein activity, comprising administering a composition to a subject in need thereof, wherein the composition comprises:

a. a guide RNA comprising
   i. a guide sequence selected from SEQ ID NOs: 1-149; or
   ii. at least 17, 18, 19, or 20 contiguous nucleotides of a sequence selected from SEQ ID NOs: 1-149; or
   iii. a guide sequence that is at least 95%, 90%, or 85% identical to a sequence selected from SEQ ID NOs: 1-149; or
   iv. a guide sequence comprising any one of SEQ ID NOs: 1, 7, 8, 15, 26, 27, 28, 41, 42, 46, 51, 52, 53, 56, 69, or 71; or
   v. a guide sequence comprising any one of SEQ ID Nos: 8, 15, 41, 51, or 69; or vi. a sequence that comprises 15 consecutive nucleotides plus-or-minus 10 nucleotides of a genomic coordinate listed in Table 1; or
vii. at least 17, 18, 19, or 20 contiguous nucleotides of a sequence selected from the sequences of (vi); or
viii. a guide sequence that is at least 95%, 90%, or 85% identical to a sequence selected from the sequences of (vi); and optionally b. an RNA-guided DNA binding agent or nucleic acid encoding an RNA-guided DNA binding agent, thereby achieving remission of angioedema attacks in a subject, wherein total plasma kallikrein activity is reduced.

Embodiment 9 is the method of embodiment 8, further comprising an activation step to convert prekallikrein to its active form, pKal.

Embodiment 10 is the method of embodiment 8, wherein the total plasma kallikrein activity is reduced by more than 60%, more than 85%, or more than 60-80%.

Embodiment 11 is a method of reducing total plasma kallikrein levels, comprising administering a composition to a subject in need thereof, wherein the composition comprises:

a. a guide RNA comprising
i. a guide sequence selected from SEQ ID NOs: 1-149; or
ii. at least 17, 18, 19, or 20 contiguous nucleotides of a sequence selected from SEQ ID NOs: 1-149; or
iii. a guide sequence that is at least 95%, 90%, or 85% identical to a sequence selected from SEQ ID NOs: 1-149; or
iv. a guide sequence comprising any one of SEQ ID NOs: 1, 7, 8, 15, 26, 27, 28, 41, 42, 46, 51, 52, 53, 56, 69, or 71; or
v. a guide sequence comprising any one of SEQ ID Nos: 8, 15, 41, 51, or 69; or
vi. a sequence that comprises 15 consecutive nucleotides plus-or-minus 10 nucleotides of a genomic coordinate listed in Table 1; or
vii. at least 17, 18, 19, or 20 contiguous nucleotides of a sequence selected from the sequences of (vi); or
viii. a guide sequence that is at least 95%, 90%, or 85% identical to a sequence selected from the sequences of (vi); and optionally b. an RNA-guided DNA binding agent or nucleic acid encoding an RNA-guided DNA binding agent, thereby total plasma kallikrein levels.

Embodiment 12 is a method of reducing prekallikrein and/or kallikrein levels, comprising administering a composition to a subject in need thereof, wherein the composition comprises:

a. a guide RNA comprising
i. a guide sequence selected from SEQ ID NOs: 1-149; or
ii. at least 17, 18, 19, or 20 contiguous nucleotides of a sequence selected from SEQ ID NOs: 1-149; or
iii. a guide sequence that is at least 95%, 90%, or 85% identical to a sequence selected from SEQ ID NOs: 1-149; or
iv. a guide sequence comprising any one of SEQ ID NOs: 1, 7, 8, 15, 26, 27, 28, 41, 42, 46, 51, 52, 53, 56, 69, or 71; or
v. a guide sequence comprising any one of SEQ ID Nos: 8, 15, 41, 51, or 69; or
vi. a sequence that comprises 15 consecutive nucleotides plus-or-minus 10 nucleotides of a genomic coordinate listed in Table 1; or
vii. at least 17, 18, 19, or 20 contiguous nucleotides of a sequence selected from the sequences of (vi); or
viii. a guide sequence that is at least 95%, 90%, or 85% identical to a sequence selected from a sequence of (vi); and optionally b. an RNA-guided DNA binding agent or nucleic acid encoding an RNA-guided DNA binding agent, thereby reducing prekallikrein and/or kallikrein.

Embodiment 13 is the method of any one of the preceding embodiments, wherein there is a dose dependent increase in percent editing.

Embodiment 14 is the method of embodiment 13, wherein there is a dose dependent reduction in total plasma kallikrein levels.

Embodiment 15 is the method of embodiment 13 or 14, wherein there is a dose dependent reduction in plasma kallikrein activity.

Embodiment 16 is the method of any one of the preceding embodiments wherein the effect is durable for at least 1 month, 2 months, 4 months, 6 months, 1 year, 2 years, 5 years, 10 years or more after the administration.

Embodiment 17 is the method of any one of the preceding embodiments wherein the effect is durable for at least 6 months.

Embodiment 18 is the method of any one of the preceding embodiments wherein the effect is durable for at least 1 year.

Embodiment 19 is the method of embodiment 6, wherein the frequency of HAE attacks is reduced.

Embodiment 20 is the method of embodiment 19, wherein the frequency is reduced by at least 40%, at least 50%, at least 60%, at least 70%, at least 80%, at least 90%, at least 60-80%, or at least 40-90%.

Embodiment 21 is the method of embodiment 20, wherein the frequency is reduced by at least 60-80%.

Embodiment 22 is the method of embodiment 20, wherein the frequency is reduced by at least 40-90%.

Embodiment 23 is the method of any one of the preceding embodiments, wherein the effect is durable for at least 1 month, 2 months, 4 months, 6 months, 1 year, 2 years, 5 years, 10 years or more after the administration.

Embodiment 24 is the method of any one of the preceding embodiments, wherein the effect is durable for at least 6 months after the administration.

Embodiment 25 is the method of any one of the preceding embodiments, wherein the effect is durable for at least 1 year after the administration.

Embodiment 26 is the method of any one of the preceding embodiments, wherein the effect is compared to a basal level.

Embodiment 27 is the method of any one of the preceding embodiments, wherein the effect is compared to a subject's basal level.

Embodiment 28 is the method of any one of the preceding embodiments, wherein an RNA-guided DNA binding agent or nucleic acid encoding an RNA-guided DNA binding agent is administered.

Embodiment 29 is a composition comprising:

a. a guide RNA comprising
i. a guide sequence selected from SEQ ID NOs: 1-149; or
ii. at least 17, 18, 19, or 20 contiguous nucleotides of a sequence selected from SEQ ID NOs: 1-149; or
iii. a guide sequence that is at least 95%, 90%, or 85% identical to a sequence selected from SEQ ID NOs: 1-149; or iv. a guide sequence comprising any one of SEQ ID NOs: 1, 7, 8, 15, 26, 27, 28, 41, 42, 46, 51, 52, 53, 56, 69, or 71; or v. a guide sequence comprising any one of SEQ ID Nos: 8, 15, 41, 51, or 69; or vi. a sequence that comprises 15 consecutive nucleotides plus-or-minus 10 nucleotides of a genomic coordinate listed in Table 1; or vii. at least 17, 18, 19, or 20 contiguous nucleotides of a sequence selected from a sequence of (vi); or viii. a guide sequence that is at least 95%, 90%, or 85% identical to a sequence selected from a sequence of (vi); and optionally b. an RNA-guided DNA binding agent or nucleic acid encoding an RNA-guided DNA binding agent.

Embodiment 30 is a composition comprising a short-single guide RNA (short-sgRNA), comprising:

a. a guide sequence comprising:

i. a guide sequence selected from SEQ ID NOs: 1-149; or ii. at least 17, 18, 19, or 20 contiguous nucleotides of a sequence selected from SEQ ID NOs: 1-149; or iii. a guide sequence that is at least 95%, 90%, or 85% identical to a sequence selected from SEQ ID NOs: 1-149; or iv. a guide sequence comprising any one of SEQ ID NOs: 1, 7, 8, 15, 26, 27, 28, 41, 42, 46, 51, 52, 53, 56, 69, or 71; or v. a guide sequence comprising any one of SEQ ID Nos: 8, 15, 41, 51, or 69; or vi. a sequence that comprises 15 consecutive nucleotides plus-or-minus 10 nucleotides of a genomic coordinate listed in Table 1; or vii. at least 17, 18, 19, or 20 contiguous nucleotides of a sequence selected from the sequences of (vi); or viii. a guide sequence that is at least 95%, 90%, or 85% identical to a sequence selected from a sequence of (vi); and b. a conserved portion of an sgRNA comprising a hairpin region, wherein the hairpin region lacks at least 5-10 nucleotides and optionally wherein the short-sgRNA comprises one or more of a 5' end modification and a 3' end modification.

Embodiment 31 is the composition of embodiment 29, comprising the sequence of SEQ ID NO: 202.

Embodiment 32 is the composition of embodiment 29 or embodiment 30, comprising a 5' end modification.

Embodiment 33 is the composition of any one of embodiments 29-32, wherein the short-sgRNA comprises a 3' end modification.

Embodiment 34 is the composition of any one of embodiments 29-33, wherein the short-sgRNA comprises a 5' end modification and a 3' end modification.

Embodiment 35 is the composition of any one of embodiments 29-34, wherein the short-sgRNA further comprises a 3' tail.

Embodiment 36 is the composition of embodiment 35, wherein the 3' tail comprises 1, 2, 3, 4, 5, 6, 7, 8, 9, or 10 nucleotides.

Embodiment 37 is the composition of embodiment 35, wherein the 3' tail comprises about 1-2, 1-3, 1-4, 1-5, 1-7, 1-10, at least 1-2, at least 1-3, at least 1-4, at least 1-5, at least 1-7, or at least 1-10 nucleotides.

Embodiment 38 is the composition of any one of embodiments 29-37, wherein the short-sgRNA does not comprise a 3' tail.

Embodiment 39 is the composition of any one of embodiments 29-38, comprising a modification in the hairpin region.

Embodiment 40 is the composition of any one of embodiments 29-39, comprising a 3' end modification, and a modification in the hairpin region.

Embodiment 41 is the composition of any one of embodiments 29-40, comprising a 3' end modification, a modification in the hairpin region, and a 5' end modification.

Embodiment 42 is the composition of any one of embodiments 29-41, comprising a 5' end modification, and a modification in the hairpin region.

Embodiment 43 is the composition of any one of embodiments 29-42, wherein the hairpin region lacks at least 5 consecutive nucleotides.

Embodiment 44 is the composition of any one of embodiments 29-43, wherein the at least 5-10 lacking nucleotides:

a. are within hairpin 1;

b. are within hairpin 1 and the "N" between hairpin 1 and hairpin 2;

c. are within hairpin 1 and the two nucleotides immediately 3' of hairpin 1;

d. include at least a portion of hairpin 1;

e. are within hairpin 2;

f. include at least a portion of hairpin 2;

g. are within hairpin 1 and hairpin 2;

h. include at least a portion of hairpin 1 and include the "N" between hairpin 1 and hairpin 2;

i. include at least a portion of hairpin 2 and include the "N" between hairpin 1 and hairpin 2;

j. include at least a portion of hairpin 1, include the "N" between hairpin 1 and hairpin 2, and include at least a portion of hairpin 2;

k. are within hairpin 1 or hairpin 2, optionally including the "N" between hairpin 1 and hairpin 2;

l. are consecutive;

m. are consecutive and include the "N" between hairpin 1 and hairpin 2;

n. are consecutive and span at least a portion of hairpin 1 and a portion of hairpin 2;

o. are consecutive and span at least a portion of hairpin 1 and the "N" between hairpin 1 and hairpin 2;

p. are consecutive and span at least a portion of hairpin 1 and two nucleotides immediately 3' of hairpin 1;

q. consist of 5-10 nucleotides;

r. consist of 6-10 nucleotides;

s. consist of 5-10 consecutive nucleotides;

t. consist of 6-10 consecutive nucleotides; or u. consist of nucleotides 54-58 of SEQ ID NO: 400.

Embodiment 45 is the composition of any one of embodiments 29-44, comprising a conserved portion of an sgRNA comprising a nexus region, wherein the nexus region lacks at least one nucleotide.

Embodiment 46 is the composition of embodiment 45, wherein the nucleotides lacking in the nexus region comprise any one or more of:

a. at least 2, 3, 4, 5, 6, 7, 8, 9, or 10 nucleotides in the nexus region;

b. at least or exactly 1-2 nucleotides, 1-3 nucleotides, 1-4 nucleotides, 1-5 nucleotides, 1-6 nucleotides, 1-10 nucleotides, or 1-15 nucleotides in the nexus region; and c. each nucleotide in the nexus region.

Embodiment 47 is a composition comprising a modified single guide RNA (sgRNA) comprising a. a guide sequence comprising:
  i. a guide sequence selected from SEQ ID NOs: 1-149; or
  ii. at least 17, 18, 19, or 20 contiguous nucleotides of a sequence selected from SEQ ID NOs: 1-149; or
  iii. a guide sequence that is at least 95%, 90%, or 85% identical to a sequence selected from SEQ ID NOs: 1-149; or
  iv. a guide sequence comprising any one of SEQ ID NOs: 1, 7, 8, 15, 26, 27, 28, 41, 42, 46, 51, 52, 53, 56, 69, or 71; or
  v. a guide sequence comprising any one of SEQ ID Nos: 8, 15, 41, 51, or 69; or
  vi. a sequence that comprises 15 consecutive nucleotides plus-or-minus 10 nucleotides of a genomic coordinate listed in Table 1; or
  vii. at least 17, 18, 19, or 20 contiguous nucleotides of a sequence selected from a sequence of (vi); or
  viii. a guide sequence that is at least 95%, 90%, or 85% identical to a sequence selected from a sequence of (vi); and further comprising
b. one or more modifications selected from:
  1. a YA modification at one or more guide region YA sites;
  2. a YA modification at one or more conserved region YA sites;
  3. a YA modification at one or more guide region YA sites and at one or more conserved region YA sites;
  4. i) a YA modification at two or more guide region YA sites;
    ii) a YA modification at one or more of conserved region YA sites 2, 3, 4, and 10; and
    iii) a YA modification at one or more of conserved region YA sites 1 and 8; or
  5. i) a YA modification at one or more guide region YA sites, wherein the guide region YA site is at or after nucleotide 8 from the 5' end of the 5' terminus;
    ii) a YA modification at one or more of conserved region YA sites 2, 3, 4, and 10; and optionally;
    iii) a YA modification at one or more of conserved region YA sites 1 and 8; or
  6. i) a YA modification at one or more guide region YA sites, wherein the guide region YA site is within 13 nucleotides of the 3' terminal nucleotide of the guide region;
    ii) a YA modification at one or more of conserved region YA sites 2, 3, 4, and 10; and
    iii) a YA modification at one or more of conserved region YA sites 1 and 8; or
  7. i) a 5' end modification and a 3' end modification;
    ii) a YA modification at one or more of conserved region YA sites 2, 3, 4, and 10; and
    iii) a YA modification at one or more of conserved region YA sites 1 and 8; or
  8. i) a YA modification at a guide region YA site, wherein the modification of the guide region YA site comprises a modification that at least one nucleotide located 5' of the guide region YA site does not comprise;
    ii) a YA modification at one or more of conserved region YA sites 2, 3, 4, and 10; and
    iii) a YA modification at one or more of conserved region YA sites 1 and 8; or
  9. i) a YA modification at one or more of conserved region YA sites 2, 3, 4, and 10; and
    ii) a YA modification at conserved region YA sites 1 and 8; or
  10. i) a YA modification at one or more guide region YA sites, wherein the YA site is at or after nucleotide 8 from the 5' terminus;
    ii) a YA modification at one or more of conserved region YA sites 2, 3, 4, and 10; and
    iii) a modification at one or more of H1-1 and H2-1; or
  11. i) a YA modification at one or more of conserved region YA sites 2, 3, 4, and 10; ii) a YA modification at one or more of conserved region YA sites 1, 5, 6, 7, 8, and 9; and iii) a modification at one or more of H1-1 and H2-1; or
  12. i) a modification, such as a YA modification, at one or more nucleotides located at or after nucleotide 6 from the 5' terminus;
    ii) a YA modification at one or more guide sequence YA sites;
    iii) a modification at one or more of B3, B4, and B5, wherein B6 does not comprise a 2'-O-Me modification or comprises a modification other than 2'-O-Me;
    iv) a modification at LS10, wherein LS10 comprises a modification other than 2'-fluoro; and/or
    v) a modification at N2, N3, N4, N5, N6, N7, N10, or N11; and wherein at least one of the following is true:
      i. a YA modification at one or more guide region YA sites;
      ii. a YA modification at one or more conserved region YA sites;
      iii. a YA modification at one or more guide region YA sites and at one or more conserved region YA sites;
      iv. at least one of nucleotides 8-11, 13, 14, 17, or 18 from the 5' end of the 5' terminus does not comprise a 2'-fluoro modification;
      v. at least one of nucleotides 6-10 from the 5' end of the 5' terminus does not comprise a phosphorothioate linkage;
      vi. at least one of B2, B3, B4, or B5 does not comprise a 2'-O-Me modification;
      vii. at least one of LS1, LS8, or LS10 does not comprise a 2'-O-Me modification;
      viii. at least one of N2, N3, N4, N5, N6, N7, N10, N11, N16, or N17 does not comprise a 2'-O-Me modification;
      ix. H1-1 comprises a modification;
      x. H2-1 comprises a modification; or
      xi. at least one of H1-2, H1-3, H1-4, H1-5, H1-6, H1-7, H1-8, H1-9, H1-10, H2-1, H2-2, H2-3, H2-4, H2-5, H2-6, H2-7, H2-8, H2-9, H2-10, H2-11, H2-12, H2-13, H2-14, or H2-15 does not comprise a phosphorothioate linkage.

Embodiment 48 is the composition of embodiment 47, comprising SEQ ID NO: 450.

Embodiment 49 is the composition of any one of embodiments 29-48, for use in inducing a double-stranded break (DSB) or a single-stranded break within the KLKB1 gene in a cell or subject.

Embodiment 50 is the composition of any one of embodiments 29-48, for use in reducing the expression of the KLKB1 gene in a cell or subject.

Embodiment 51 is the composition of any one of embodiments 29-48, for use in treating or preventing HAE in a subject.

Embodiment 52 is the composition of any one of embodiments 29-48, for use in reducing serum and/or plasma bradykinin concentration in a subject.

Embodiment 53 is the composition of any one of embodiments 29-48, for use in reducing bradykinin-mediated vasodilation concentration in a subject.

Embodiment 54 is the composition of any one of embodiments 29-48, for use in treating or preventing bradykinin production and accumulation, bradykinin-mediated vasodilation, swelling, or angioedema, obstruction of the airway, or asphyxiation.

Embodiment 55 is the composition of any one of embodiments 29-48, for use in treating or preventing angioedema caused by or associated with HAE.

Embodiment 56 is the composition of any one of embodiments 29-48, for use in reducing the frequency of angioedema attacks.

Embodiment 57 is the composition of any one of embodiments 29-48, for use in reducing the severity of angioedema attacks.

Embodiment 58 is the composition of any one of embodiments 29-48, for use in reducing the frequency and/or severity of attacks.

Embodiment 59 is the composition of any one of embodiments 29-48, for use in achieving remission of angioedema attacks.

Embodiment 60 is the composition of any one of embodiments 29-48, for use in reducing the frequency and/or severity of HAE attacks.

Embodiment 61 is the composition of embodiment 60, for use in reducing the frequency of HAE attacks.

Embodiment 62 is the composition of embodiment 61, wherein the frequency is reduced by at least 40%, at least 50%, at least 60%, at least 70%, at least 80%, at least 90%, at least 60-80%, or at least 40-90%.

Embodiment 63 is the method of embodiment 61, wherein the frequency is reduced by at least 60-80%.

Embodiment 64 is the method of embodiment 61, wherein the frequency is reduced by at least 40-90%.

Embodiment 65 is the composition of embodiment 60, for use in reducing total plasma kallikrein activity.

Embodiment 66 is the composition of embodiment 60, for use in reducing total plasma kallikrein levels.

Embodiment 67 is the composition of embodiment 60, for use in reducing prekallikrein and/or kallikrein levels.

Embodiment 68 is the composition of any one of embodiments 65-67, wherein there is a dose dependent increase in percent editing.

Embodiment 69 is the composition of any one of embodiments 65-68, wherein there is a dose dependent reduction in total plasma kallikrein levels.

Embodiment 70 is the composition of any one of embodiments 65-69, wherein there is a dose dependent reduction in plasma kallikrein activity.

Embodiment 71 is the composition of any one of embodiments 29-70, wherein the effect is durable for at least 1 month, 2 months, 4 months, 6 months, 1 year, 2 years, 5 years, 10 years or more after the administration.

Embodiment 72 is the composition of any one of embodiments 29-71, wherein the effect is durable for at least 6 months.

Embodiment 73 is the composition of any one of embodiments 29-72, wherein the effect is durable for at least 1 year.

Embodiment 74 is the method of any of embodiments 1-28, further comprising:

a. inducing a double-stranded break (DSB) within the KLKB1 gene in a cell or subject;
b. reducing the expression of the KLKB1 gene in a cell or subject;
c. treating or preventing HAE in a subject;
d. reducing serum and/or plasma bradykinin concentration in a subject;
e. reducing bradykinin production;
f. reducing bradykinin-mediated vasodilation;
g. treating or preventing bradykinin-mediated swelling and angioedema; and/or
h. treating or preventing obstruction of the airway or asphyxiation caused by swelling.

Embodiment 75 is the method, composition, or composition for use of any one the preceding embodiments, wherein the composition decreases KLKB1 mRNA production.

Embodiment 76 is the method, composition, or composition for use of any one the preceding embodiments, wherein the composition decreases prekallikrein protein levels in plasma or serum.

Embodiment 77 is the method, composition, or composition for use of any one the preceding embodiments, wherein the composition decreases total kallikrein (prekallikrein and pKal) protein levels in plasma or serum.

Embodiment 78 is the method, composition, or composition for use of any one the preceding embodiments, wherein the composition decreases the proportion of circulating cleaved HMWK (cHMWK) compared to total HMWK in citrated serum or citrated plasma.

Embodiment 79 is the method, composition, or composition for use of any one the preceding embodiments, wherein the composition reduces a subject's proportion of cHMWK in citrated plasma to below 30% of total HMWK.

Embodiment 80 is the method, composition, or composition for use of any one the preceding embodiments, wherein the composition decreases the spontaneous pKal activity in serum or plasma.

Embodiment 81 is the method, composition, or composition for use of any one the preceding embodiments, wherein the composition decreases kallikrein activity.

Embodiment 82 is the method, composition, or composition for use of any one the preceding embodiments, wherein the kallikrein activity comprises total kallikrein activity, prekallikrein activity, and/or pKal activity.

Embodiment 83 is the method, composition, or composition for use of any one the preceding embodiments, wherein the composition reduces a subject's pKal activity by at least about 40% prior to the method or use of the composition.

Embodiment 84 is the method, composition, or composition for use of any one the preceding embodiments, wherein the composition reduces a subject's pKal activity by at least about 50% prior to the method or use of the composition.

Embodiment 85 is the method, composition, or composition for use of any one the preceding embodiments, wherein the composition reduces a subject's pKal activity by at least about 60% prior to the method or use of the composition.

Embodiment 86 is the method, composition, or composition for use of any one the preceding embodiments, wherein the composition reduces a subject's pKal activity to less than about 40% of basal levels.

Embodiment 87 is the method, composition, or composition for use of any one the preceding embodiments, wherein the composition reduces a subject's pKal activity to about 40-50% of basal levels.

Embodiment 88 is the method, composition, or composition for use of any one the preceding embodiments, wherein the composition reduces a subject's pKal activity to 20-40% or 20-50% of basal levels.

Embodiment 89 is the method, composition, or composition for use of any one the preceding embodiments, wherein the composition increases serum and/or plasma bradykinin levels.

Embodiment 90 is the method, composition, or composition for use of any one the preceding embodiments, wherein the composition results in editing of the KLKB1 gene.

Embodiment 91 is the method, composition, or composition for use of embodiment 90, wherein the editing is calculated as a percentage of the population that is edited (percent editing).

Embodiment 92 is the method, composition, or composition for use of embodiment 91, wherein the percent editing is between 30 and 99% of the population.

Embodiment 93 is the method, composition, or composition for use of embodiment 91, wherein the percent editing is between 30 and 35%, 35 and 40%, 40 and 45%, 45 and 50%, 50 and 55%, 55 and 60%, 60 and 65%, 65 and 70%, 70 and 75%, 75 and 80%, 80 and 85%, 85 and 90%, 90 and 95%, or 95 and 99% of the population.

Embodiment 94 is the method, composition, or composition for use of any one the preceding embodiments, wherein the composition reduces serum and/or plasma bradykinin concentration.

Embodiment 95 is the method, composition, or composition for use of any one the preceding embodiments, wherein the composition reduces serum and/or plasma bradykinin concentration, and wherein a reduction in serum and/or plasma bradykinin results in decreased swelling in organ tissues, including limbs, face, GI tract, or airway.

Embodiment 96 is the method, composition for use, or composition of any one of the preceding embodiments, wherein the guide sequence is selected from a. SEQ ID NOs: 1-149; or
b. SEQ ID NOs: 1, 7, 8, 15, 26, 27, 28, 41, 42, 46, 51, 52, 53, 56, 69, or 71; or
c. any one of SEQ ID Nos: 8, 15, 41, 51, or 69; or
d. a sequence that comprises 15 consecutive nucleotides plus-or-minus 10 nucleotides of a genomic coordinate listed in Table 1; or
e. at least 17, 18, 19, or 20 contiguous nucleotides of a sequence from (d); or
f. a guide sequence that is at least 95%, 90%, or 85% identical to a sequence selected from a sequence of (d).

Embodiment 97 is the method, composition for use, or composition of any one of the preceding embodiments, wherein the composition comprises an sgRNA comprising:

a. SEQ ID NOs: 1, 7, 8, 15, 26, 27, 28, 41, 42, 46, 51, 52, 53, 56, 69, or 71; or
b. any one of SEQ ID Nos: 8, 15, 41, 51, or 69; or
c. a sequence that comprises 15 consecutive nucleotides plus-or-minus 10 nucleotides of a genomic coordinate listed in Table 1; or
d. at least 17, 18, 19, or 20 contiguous nucleotides of a sequence from (c); or
e. a guide sequence that is at least 95%, 90%, or 85% identical to a sequence selected from a sequence of (c).

Embodiment 98 is the method, composition for use, or composition of any one of the preceding embodiments, wherein the target sequence is in exon 1, exon 3, exon 4, exon 5, exon 6, or exon 8, exon 9, exon 10, exon 11, exon 12, exon 13, exon 14, or exon 15 of the human KLKB1 gene.

Embodiment 99 is the method, composition for use, or composition of embodiment 98, wherein the target sequence is in exon 1 of the human KLKB1 gene.

Embodiment 100 is the method, composition for use, or composition of embodiment 98, wherein the target sequence is in exon 3 of the human KLKB1 gene.

Embodiment 101 is the method, composition for use, or composition of embodiment 98, wherein the target sequence is in exon 4 of the human KLKB1 gene.

Embodiment 102 is the method, composition for use, or composition of embodiment 98, wherein the target sequence is in exon 5 of the human KLKB1 gene.

Embodiment 103 is the method, composition for use, or composition of embodiment 98, wherein the target sequence is in exon 6 of the human KLKB1 gene.

Embodiment 104 is the method, composition for use, or composition of embodiment 98, wherein the target sequence is in exon 8 of the human KLKB1 gene.

Embodiment 105 is the method, composition for use, or composition of embodiment 98, wherein the target sequence is in exon 9 of the human KLKB1 gene.

Embodiment 106 is the method, composition for use, or composition of embodiment 98, wherein the target sequence is in exon 10 of the human KLKB1 gene.

Embodiment 107 is the method, composition for use, or composition of embodiment 98, wherein the target sequence is in exon 11 of the human KLKB1 gene.

Embodiment 108 is the method, composition for use, or composition of embodiment 98, wherein the target sequence is in exon 12 of the human KLKB1 gene.

Embodiment 109 is the method, composition for use, or composition of embodiment 98, wherein the target sequence is in exon 13 of the human KLKB1 gene.

Embodiment 110 is the method, composition for use, or composition of embodiment 98, wherein the target sequence is in exon 14 of the human KLKB1 gene.

Embodiment 111 is the method, composition for use, or composition of embodiment 98, wherein the target sequence is in exon 15 of the human KLKB1 gene.

Embodiment 112 is the method, composition for use, or composition of any one of the preceding embodiments, wherein the guide sequence is complementary to a target sequence in the positive strand of KLKB1.

Embodiment 113 is the method, composition for use, or composition of any one of the preceding embodiments, wherein the guide sequence is complementary to a target sequence in the negative strand of KLKB1.

Embodiment 114 is the method, composition for use, or composition of any one of the preceding embodiments, wherein the first guide sequence is complementary to a first target sequence in the positive strand of the KLKB1 gene, and wherein the composition further comprises a second guide sequence that is complementary to a second target sequence in the negative strand of the KLKB1 gene.

Embodiment 115 is the method, composition for use, or composition of any one of the preceding embodiments, wherein the guide RNA comprises a guide sequence selected from any one of SEQ ID Nos 1-149 and further comprises a nucleotide sequence of SEQ ID NO: 170, wherein the nucleotides of SEQ ID NO: 170 follow the guide sequence at its 3' end.

Embodiment 116 is the method, composition for use, or composition of any one of the preceding embodiments, wherein the guide RNA comprises a guide sequence selected from any one of SEQ ID Nos: 1-149 and further comprises a nucleotide sequence of SEQ ID NO: 171, SEQ ID NO: 172, SEQ ID NO: 173, or any one of SEQ ID Nos: 400-450, wherein the nucleotides of SEQ ID NO: 171, SEQ ID NO: 172, SEQ ID NO: 173, or any one of conserved portions of sgRNA from Table 4 follow the guide sequence at its 3' end.

Embodiment 117 is the method, composition for use, or composition of any one of the preceding embodiments, wherein the guide RNA is a single guide RNA (sgRNA).

Embodiment 118 is the method, composition for use, or composition of embodiment 117, wherein the sgRNA comprises a guide sequence comprising any one of SEQ ID Nos: 8, 15, 41, 51, or 69.

Embodiment 119 is the method, composition for use, or composition of any one of the preceding embodiments, wherein the guide RNA is modified according to the pattern of SEQ ID NO: 300, wherein the Ns are collectively any one of the guide sequences of Table 1 (SEQ ID Nos: 1-149).

Embodiment 120 is the method, composition for use, or composition of embodiment 119, wherein each N in SEQ ID NO: 300 is any natural or non-natural nucleotide, wherein the Ns form the guide sequence, and the guide sequence targets Cas9 to the KLKB1 gene.

Embodiment 121 is the method, composition for use, or composition of any one of the preceding embodiments, wherein the sgRNA comprises any one of the guide sequences of SEQ ID NOs: 1-149 and the nucleotides of SEQ ID NO: 171, SEQ ID NO: 172, SEQ ID NO: 173, or any of the conserved portions of sgRNA from Table 4, wherein the nucleotides of SEQ ID NO: 171, SEQ ID NO: 172, SEQ ID NO: 173, or any of the conserved portions of sgRNA from Table 4 follow the guide sequence at its 3' end.

Embodiment 122 is the method, composition for use, or composition of any one of the preceding embodiments, wherein the sgRNA comprises a guide sequence that is at least 95%, 90%, or 85% identical to a sequence selected from SEQ ID Nos: 1-149.

Embodiment 123 is the method, composition for use, or composition of embodiment 122, wherein the sgRNA comprises a sequence selected from SEQ ID Nos: 8, 15, 41, 51, or 69.

Embodiment 124 is the method, composition for use, or composition of any one of the preceding embodiments, wherein the guide RNA comprises at least one modification.

Embodiment 125 is the method, composition for use, or composition of embodiment 124, wherein the at least one modification includes a 2'-O-methyl (2'-O-Me) modified nucleotide.

Embodiment 126 is the method, composition for use, or composition of any one of embodiments 124-125, comprising a phosphorothioate (PS) bond between nucleotides.

Embodiment 127 is the method, composition for use, or composition of any one of embodiments 124-126, comprising a 2'-fluoro (2'-F) modified nucleotide.

Embodiment 128 is the method, composition for use, or composition of any one of embodiments 124-127, comprising a modification at one or more of the first five nucleotides at the 5' end of the guide RNA.

Embodiment 129 is the method, composition for use, or composition of any one of embodiments 124-128, comprising a modification at one or more of the last five nucleotides at the 3' end of the guide RNA.

Embodiment 130 is the method, composition for use, or composition of any one of embodiments 124-129, comprising a PS bond between the first four nucleotides of the guide RNA.

Embodiment 131 is the method, composition for use, or composition of any one of embodiments 124-130, comprising a PS bond between the last four nucleotides of the guide RNA.

Embodiment 132 is the method, composition for use, or composition of any one of embodiments 124-131, comprising a 2'-O-Me modified nucleotide at the first three nucleotides at the 5' end of the guide RNA.

Embodiment 133 is the method, composition for use, or composition of any one of embodiments 124-132, comprising a 2'-O-Me modified nucleotide at the last three nucleotides at the 3' end of the guide RNA.

Embodiment 134 is the method, composition for use, or composition of any one of embodiments 124-133, wherein the guide RNA comprises the modified nucleotides of SEQ ID NO: 300.

Embodiment 135 is the method, composition for use, or composition of any one of the preceding embodiments, wherein the composition further comprises a pharmaceutically acceptable excipient.

Embodiment 136 is the method, composition for use, or composition of any one of the preceding embodiments, wherein the guide RNA is associated with a lipid nanoparticle (LNP).

Embodiment 137 is the method, composition for use, or composition of embodiment 136, wherein the LNP comprises a cationic lipid.

Embodiment 138 is the method, composition for use, or composition of embodiment 137, wherein the cationic lipid is (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate.

Embodiment 139 is the method, composition for use, or composition of any one of embodiments 136-138, wherein the LNP comprises a neutral lipid.

Embodiment 140 is the method, composition for use, or composition of embodiment 139, wherein the neutral lipid is DSPC.

Embodiment 141 is the method, composition for use, or composition of any one of embodiments 136-140, wherein the LNP comprises a helper lipid.

Embodiment 142 is the method, composition for use, or composition of embodiment 141, wherein the helper lipid is cholesterol.

Embodiment 143 is the method, composition for use, or composition of any one of embodiments 136-142, wherein the LNP comprises a stealth lipid.

Embodiment 144 is the method, composition for use, or composition of embodiment 143, wherein the stealth lipid is PEG2k-DMG.

Embodiment 145 is the method, composition for use, or composition of any one of the preceding embodiments, wherein the composition further comprises an RNA-guided DNA binding agent.

Embodiment 146 is the method, composition for use, or composition of any one of the preceding embodiments, wherein the composition further comprises an mRNA that encodes an RNA-guided DNA binding agent.

Embodiment 147 is the method, composition for use, or composition of embodiment 145 or 146, wherein the RNA-guided DNA binding agent is Cas9.

Embodiment 148 is the method, composition for use, or composition of any one of the preceding embodiments, wherein the composition is a pharmaceutical formulation and further comprises a pharmaceutically acceptable carrier.

Embodiment 149 is the method, composition for use, or composition of any one of the preceding embodiments, wherein the composition comprises a sequence selected from SEQ ID NOs: 1-149, which is SEQ ID NO: 1.

Embodiment 150 is the method, composition for use, or composition of any one of the preceding embodiments, wherein the composition comprises a sequence selected from SEQ ID NOs: 1-149, which is SEQ ID NO: 2.

Embodiment 151 is the method, composition for use, or composition of any one of the preceding embodiments, wherein the composition comprises a sequence selected from SEQ ID NOs: 1-149, which is SEQ ID NO: 3.

Embodiment 152 is the method, composition for use, or composition of any one of the preceding embodiments, wherein the composition comprises a sequence selected from SEQ ID NOs: 1-149, which is SEQ ID NO: 4.

Embodiment 153 is the method, composition for use, or composition of any one of embodiments 1-89, wherein the sequence selected from SEQ ID NOs: 1-149 is SEQ ID NO: 5.

Embodiment 154 is the method, composition for use, or composition of any one of embodiments 1-89, wherein the sequence selected from SEQ ID NOs: 1-149 is SEQ ID NO: 6.

Embodiment 155 is the method, composition for use, or composition of any one of embodiments 1-89, wherein the sequence selected from SEQ ID NOs: 1-149 is SEQ ID NO: 7.

Embodiment 156 is the method, composition for use, or composition of any one of the preceding embodiments, wherein the composition comprises a sequence selected from SEQ ID NOs: 1-149, which is SEQ ID NO: 8.

Embodiment 157 is the method, composition for use, or composition of any one of the preceding embodiments, wherein the composition comprises a sequence selected from SEQ ID NOs: 1-149, which is SEQ ID NO: 9.

Embodiment 158 is the method, composition for use, or composition of any one of the preceding embodiments, wherein the composition comprises a sequence selected from SEQ ID NOs: 1-149, which is SEQ ID NO: 10.

Embodiment 159 is the method, composition for use, or composition of any one of the preceding embodiments, wherein the composition comprises a sequence selected from SEQ ID NOs: 1-149, which is SEQ ID NO: 11.

Embodiment 160 is the method, composition for use, or composition of any one of the preceding embodiments, wherein the composition comprises a sequence selected from SEQ ID NOs: 1-149, which is SEQ ID NO: 12.

Embodiment 161 is the method, composition for use, or composition of any one of the preceding embodiments, wherein the composition comprises a sequence selected from SEQ ID NOs: 1-149, which is SEQ ID NO: 13.

Embodiment 162 is the method, composition for use, or composition of any one of the preceding embodiments, wherein the composition comprises a sequence selected from SEQ ID NOs: 1-149, which is SEQ ID NO: 14.

Embodiment 163 is the method, composition for use, or composition of any one of the preceding embodiments, wherein the composition comprises a sequence selected from SEQ ID NOs: 1-149, which is SEQ ID NO: 15.

Embodiment 164 is the method, composition for use, or composition of any one of the preceding embodiments, wherein the composition comprises a sequence selected from SEQ ID NOs: 1-149, which is SEQ ID NO: 16.

Embodiment 165 is the method, composition for use, or composition of any one of the preceding embodiments, wherein the composition comprises a sequence selected from SEQ ID NOs: 1-149, which is SEQ ID NO: 17.

Embodiment 166 is the method, composition for use, or composition of any one of the preceding embodiments, wherein the composition comprises a sequence selected from SEQ ID NOs: 1-149, which is SEQ ID NO: 18.

Embodiment 167 is the method, composition for use, or composition of any one of the preceding embodiments, wherein the composition comprises a sequence selected from SEQ ID NOs: 1-149, which is SEQ ID NO: 19.

Embodiment 168 is the method, composition for use, or composition of any one of the preceding embodiments, wherein the composition comprises a sequence selected from SEQ ID NOs: 1-149, which is SEQ ID NO: 20.

Embodiment 169 is the method, composition for use, or composition of any one of the preceding embodiments, wherein the composition comprises a sequence selected from SEQ ID NOs: 1-149, which is SEQ ID NO: 21.

Embodiment 170 is the method, composition for use, or composition of any one of the preceding embodiments, wherein the composition comprises a sequence selected from SEQ ID NOs: 1-149, which is SEQ ID NO: 22.

Embodiment 171 is the method, composition for use, or composition of any one of the preceding embodiments, wherein the composition comprises a sequence selected from SEQ ID NOs: 1-149, which is SEQ ID NO: 23.

Embodiment 172 is the method, composition for use, or composition of any one of the preceding embodiments, wherein the composition comprises a sequence selected from SEQ ID NOs: 1-149, which is SEQ ID NO: 24.

Embodiment 173 is the method, composition for use, or composition of any one of the preceding embodiments, wherein the composition comprises a sequence selected from SEQ ID NOs: 1-149, which is SEQ ID NO: 25.

Embodiment 174 is the method, composition for use, or composition of any one of the preceding embodiments, wherein the composition comprises a sequence selected from SEQ ID NOs: 1-149, which is SEQ ID NO: 26.

Embodiment 175 is the method, composition for use, or composition of any one of the preceding embodiments, wherein the composition comprises a sequence selected from SEQ ID NOs: 1-149, which is SEQ ID NO: 27.

Embodiment 176 is the method, composition for use, or composition of any one of the preceding embodiments, wherein the composition comprises a sequence selected from SEQ ID NOs: 1-149, which is SEQ ID NO: 28.

Embodiment 177 is the method, composition for use, or composition of any one of the preceding embodiments, wherein the composition comprises a sequence selected from SEQ ID NOs: 1-149, which is SEQ ID NO: 29.

Embodiment 178 is the method, composition for use, or composition of any one of the preceding embodiments, wherein the composition comprises a sequence selected from SEQ ID NOs: 1-149, which is SEQ ID NO: 30.

Embodiment 179 is the method, composition for use, or composition of any one of the preceding embodiments, wherein the composition comprises a sequence selected from SEQ ID NOs: 1-149, which is SEQ ID NO: 31.

Embodiment 180 is the method, composition for use, or composition of any one of the preceding embodiments, wherein the composition comprises a sequence selected from SEQ ID NOs: 1-149, which is SEQ ID NO: 32.

Embodiment 181 is the method, composition for use, or composition of any one of the preceding embodiments, wherein the composition comprises a sequence selected from SEQ ID NOs: 1-149, which is SEQ ID NO: 33.

Embodiment 182 is the method, composition for use, or composition of any one of the preceding embodiments, wherein the composition comprises a sequence selected from SEQ ID NOs: 1-149, which is SEQ ID NO: 34.

Embodiment 183 is the method, composition for use, or composition of any one of the preceding embodiments, wherein the composition comprises a sequence selected from SEQ ID NOs: 1-149, which is SEQ ID NO: 35.

Embodiment 184 is the method, composition for use, or composition of any one of the preceding embodiments, wherein the composition comprises a sequence selected from SEQ ID NOs: 1-149, which is SEQ ID NO: 36.

Embodiment 185 is the method, composition for use, or composition of any one of the preceding embodiments, wherein the composition comprises a sequence selected from SEQ ID NOs: 1-149, which is SEQ ID NO: 37.

Embodiment 186 is the method, composition for use, or composition of any one of the preceding embodiments, wherein the composition comprises a sequence selected from SEQ ID NOs: 1-149, which is SEQ ID NO: 38.

Embodiment 187 is the method, composition for use, or composition of any one of the preceding embodiments, wherein the composition comprises a sequence selected from SEQ ID NOs: 1-149, which is SEQ ID NO: 39.

Embodiment 188 is the method, composition for use, or composition of any one of the preceding embodiments, wherein the composition comprises a sequence selected from SEQ ID NOs: 1-149, which is SEQ ID NO: 40.

Embodiment 189 is the method, composition for use, or composition of any one of the preceding embodiments, wherein the composition comprises a sequence selected from SEQ ID NOs: 1-149, which is SEQ ID NO: 41.

Embodiment 190 is the method, composition for use, or composition of any one of the preceding embodiments, wherein the composition comprises a sequence selected from SEQ ID NOs: 1-149, which is SEQ ID NO: 42.

Embodiment 191 is the method, composition for use, or composition of any one of the preceding embodiments, wherein the composition comprises a sequence selected from SEQ ID NOs: 1-149, which is SEQ ID NO: 43.

Embodiment 192 is the method, composition for use, or composition of any one of the preceding embodiments, wherein the composition comprises a sequence selected from SEQ ID NOs: 1-149, which is SEQ ID NO: 44.

Embodiment 193 is the method, composition for use, or composition of any one of the preceding embodiments, wherein the composition comprises a sequence selected from SEQ ID NOs: 1-149, which is SEQ ID NO: 45.

Embodiment 194 is the method, composition for use, or composition of any one of the preceding embodiments, wherein the composition comprises a sequence selected from SEQ ID NOs: 1-149, which is SEQ ID NO: 46.

Embodiment 195 is the method, composition for use, or composition of any one of the preceding embodiments, wherein the composition comprises a sequence selected from SEQ ID NOs: 1-149, which is SEQ ID NO: 47.

Embodiment 196 is the method, composition for use, or composition of any one of the preceding embodiments, wherein the composition comprises a sequence selected from SEQ ID NOs: 1-149, which is SEQ ID NO: 48.

Embodiment 197 is the method, composition for use, or composition of any one of the preceding embodiments, wherein the composition comprises a sequence selected from SEQ ID NOs: 1-149, which is SEQ ID NO: 49.

Embodiment 198 is the method, composition for use, or composition of any one of the preceding embodiments, wherein the composition comprises a sequence selected from SEQ ID NOs: 1-149, which is SEQ ID NO: 50.

Embodiment 199 is the method, composition for use, or composition of any one of the preceding embodiments, wherein the composition comprises a sequence selected from SEQ ID NOs: 1-149, which is SEQ ID NO: 51.

Embodiment 200 is the method, composition for use, or composition of any one of the preceding embodiments, wherein the composition comprises a sequence selected from SEQ ID NOs: 1-149, which is SEQ ID NO: 52.

Embodiment 201 is the method, composition for use, or composition of any one of the preceding embodiments, wherein the composition comprises a sequence selected from SEQ ID NOs: 1-149, which is SEQ ID NO: 53.

Embodiment 202 is the method, composition for use, or composition of any one of the preceding embodiments, wherein the composition comprises a sequence selected from SEQ ID NOs: 1-149, which is SEQ ID NO: 54.

Embodiment 203 is the method, composition for use, or composition of any one of the preceding embodiments, wherein the composition comprises a sequence selected from SEQ ID NOs: 1-149, which is SEQ ID NO: 55.

Embodiment 204 is the method, composition for use, or composition of any one of the preceding embodiments, wherein the composition comprises a sequence selected from SEQ ID NOs: 1-149, which is SEQ ID NO: 56.

Embodiment 205 is the method, composition for use, or composition of any one of the preceding embodiments, wherein the composition comprises a sequence selected from SEQ ID NOs: 1-149, which is SEQ ID NO: 57.

Embodiment 206 is the method, composition for use, or composition of any one of the preceding embodiments, wherein the composition comprises a sequence selected from SEQ ID NOs: 1-149, which is SEQ ID NO: 58.

Embodiment 207 is the method, composition for use, or composition of any one of the preceding embodiments, wherein the composition comprises a sequence selected from SEQ ID NOs: 1-149, which is SEQ ID NO: 59.

Embodiment 208 is the method, composition for use, or composition of any one of the preceding embodiments, wherein the composition comprises a sequence selected from SEQ ID NOs: 1-149, which is SEQ ID NO: 60.

Embodiment 209 is the method, composition for use, or composition of any one of the preceding embodiments, wherein the composition comprises a sequence selected from SEQ ID NOs: 1-149, which is SEQ ID NO: 61.

Embodiment 210 is the method, composition for use, or composition of any one of the preceding embodiments, wherein the composition comprises a sequence selected from SEQ ID NOs: 1-149, which is SEQ ID NO: 62.

Embodiment 211 is the method, composition for use, or composition of any one of the preceding embodiments, wherein the composition comprises a sequence selected from SEQ ID NOs: 1-149, which is SEQ ID NO: 63.

Embodiment 212 is the method, composition for use, or composition of any one of the preceding embodiments, wherein the composition comprises a sequence selected from SEQ ID NOs: 1-149, which is SEQ ID NO: 64.

Embodiment 213 is the method, composition for use, or composition of any one of the preceding embodiments, wherein the composition comprises a sequence selected from SEQ ID NOs: 1-149, which is SEQ ID NO: 65.

Embodiment 214 is the method, composition for use, or composition of any one of the preceding embodiments, wherein the composition comprises a sequence selected from SEQ ID NOs: 1-149, which is SEQ ID NO: 66.

Embodiment 215 is the method, composition for use, or composition of any one of the preceding embodiments, wherein the composition comprises a sequence selected from SEQ ID NOs: 1-149, which is SEQ ID NO: 67.

Embodiment 216 is the method, composition for use, or composition of any one of the preceding embodiments, wherein the composition comprises a sequence selected from SEQ ID NOs: 1-149, which is SEQ ID NO: 68.

Embodiment 217 is the method, composition for use, or composition of any one of the preceding embodiments, wherein the composition comprises a sequence selected from SEQ ID NOs: 1-149, which is SEQ ID NO: 69.

Embodiment 218 is the method, composition for use, or composition of any one of the preceding embodiments, wherein the composition comprises a sequence selected from SEQ ID NOs: 1-149, which is SEQ ID NO: 70.

Embodiment 219 is the method, composition for use, or composition of any one of the preceding embodiments, wherein the composition comprises a sequence selected from SEQ ID NOs: 1-149, which is SEQ ID NO: 71.

Embodiment 220 is the method, composition for use, or composition of any one of the preceding embodiments, wherein the composition comprises a sequence selected from SEQ ID NOs: 1-149, which is SEQ ID NO: 72.

Embodiment 221 is the method, composition for use, or composition of any one of the preceding embodiments, wherein the composition comprises a sequence selected from SEQ ID NOs: 1-149, which is SEQ ID NO: 73.

Embodiment 222 is the method, composition for use, or composition of any one of the preceding embodiments, wherein the composition comprises a sequence selected from SEQ ID NOs: 1-149, which is SEQ ID NO: 74.

Embodiment 223 is the method, composition for use, or composition of any one of the preceding embodiments, wherein the composition comprises a sequence selected from SEQ ID NOs: 1-149, which is SEQ ID NO: 75.

Embodiment 224 is the method, composition for use, or composition of any one of the preceding embodiments, wherein the composition comprises a sequence selected from SEQ ID NOs: 1-149, which is SEQ ID NO: 76.

Embodiment 225 is the method, composition for use, or composition of any one of the preceding embodiments, wherein the composition comprises a sequence selected from SEQ ID NOs: 1-149, which is SEQ ID NO: 77.

Embodiment 226 is the method, composition for use, or composition of any one of the preceding embodiments, wherein the composition comprises a sequence selected from SEQ ID NOs: 1-149, which is SEQ ID NO: 78.

Embodiment 227 is the method, composition for use, or composition of any one of the preceding embodiments, wherein the composition comprises a sequence selected from SEQ ID NOs: 1-149, which is SEQ ID NO: 79.

Embodiment 228 is the method, composition for use, or composition of any one of the preceding embodiments, wherein the composition comprises a sequence selected from SEQ ID NOs: 1-149, which is SEQ ID NO: 80.

Embodiment 229 is the method, composition for use, or composition of any one of the preceding embodiments, wherein the composition comprises a sequence selected from SEQ ID NOs: 1-149, which is SEQ ID NO: 81.

Embodiment 230 is the method, composition for use, or composition of any one of the preceding embodiments, wherein the composition comprises a sequence selected from SEQ ID NOs: 1-149, which is SEQ ID NO: 82.

Embodiment 231 is the method, composition for use, or composition of any one of the preceding embodiments, wherein the composition comprises a sequence selected from SEQ ID NOs: 1-149, which is SEQ ID NO: 83.

Embodiment 232 is the method, composition for use, or composition of any one of the preceding embodiments, wherein the composition comprises a sequence selected from SEQ ID NOs: 1-149, which is SEQ ID NO: 84.

Embodiment 233 is the method, composition for use, or composition of any one of the preceding embodiments, wherein the composition comprises a sequence selected from SEQ ID NOs: 1-149, which is SEQ ID NO: 85.

Embodiment 234 is the method, composition for use, or composition of any one of the preceding embodiments, wherein the composition comprises a sequence selected from SEQ ID NOs: 1-149, which is SEQ ID NO: 86.

Embodiment 235 is the method, composition for use, or composition of any one of the preceding embodiments, wherein the composition comprises a sequence selected from SEQ ID NOs: 1-149, which is SEQ ID NO: 87.

Embodiment 236 is the method, composition for use, or composition of any one of the preceding embodiments, wherein the composition comprises a sequence selected from SEQ ID NOs: 1-149, which is SEQ ID NO: 88.

Embodiment 237 is the method, composition for use, or composition of any one of the preceding embodiments, wherein the composition comprises a sequence selected from SEQ ID NOs: 1-149, which is SEQ ID NO: 89.

Embodiment 238 is the method, composition for use, or composition of any one of embodiments 1-89, wherein the sequence selected from SEQ ID NOs: 1-149 is SEQ ID NO: 90.

Embodiment 239 is the method, composition for use, or composition of any one of embodiments 1-89, wherein the sequence selected from SEQ ID NOs: 1-149 is SEQ ID NO: 91.

Embodiment 240 is the method, composition for use, or composition of any one of embodiments 1-89, wherein the sequence selected from SEQ ID NOs: 1-149 is SEQ ID NO: 92.

Embodiment 241 is the method, composition for use, or composition of any one of the preceding embodiments, wherein the composition comprises a sequence selected from SEQ ID NOs: 1-149, which is SEQ ID NO: 93.

Embodiment 242 is the method, composition for use, or composition of any one of the preceding embodiments, wherein the composition comprises a sequence selected from SEQ ID NOs: 1-149, which is SEQ ID NO: 94.

Embodiment 243 is the method, composition for use, or composition of any one of the preceding embodiments, wherein the composition comprises a sequence selected from SEQ ID NOs: 1-149, which is SEQ ID NO: 95.

Embodiment 244 is the method, composition for use, or composition of any one of the preceding embodiments, wherein the composition comprises a sequence selected from SEQ ID NOs: 1-149, which is SEQ ID NO: 96.

Embodiment 245 is the method, composition for use, or composition of any one of the preceding embodiments, wherein the composition comprises a sequence selected from SEQ ID NOs: 1-149, which is SEQ ID NO: 97.

Embodiment 246 is the method, composition for use, or composition of any one of the preceding embodiments, wherein the composition comprises a sequence selected from SEQ ID NOs: 1-149, which is SEQ ID NO: 98.

Embodiment 247 is the method, composition for use, or composition of any one of the preceding embodiments, wherein the composition comprises a sequence selected from SEQ ID NOs: 1-149, which is SEQ ID NO: 99.

Embodiment 248 is the method, composition for use, or composition of any one of the preceding embodiments, wherein the composition comprises a sequence selected from SEQ ID NOs: 1-149, which is SEQ ID NO: 100.

Embodiment 249 is the method, composition for use, or composition of any one of the preceding embodiments, wherein the composition comprises a sequence selected from SEQ ID NOs: 1-149, which is SEQ ID NO: 101.

Embodiment 250 is the method, composition for use, or composition of any one of the preceding embodiments, wherein the composition comprises a sequence selected from SEQ ID NOs: 1-149, which is SEQ ID NO: 102.

Embodiment 251 is the method, composition for use, or composition of any one of the preceding embodiments, wherein the composition comprises a sequence selected from SEQ ID NOs: 1-149, which is SEQ ID NO: 103.

Embodiment 252 is the method, composition for use, or composition of any one of the preceding embodiments, wherein the composition comprises a sequence selected from SEQ ID NOs: 1-149, which is SEQ ID NO: 104.

Embodiment 253 is the method, composition for use, or composition of any one of the preceding embodiments, wherein the composition comprises a sequence selected from SEQ ID NOs: 1-149, which is SEQ ID NO: 105.

Embodiment 254 is the method, composition for use, or composition of any one of the preceding embodiments, wherein the composition comprises a sequence selected from SEQ ID NOs: 1-149, which is SEQ ID NO: 106.

Embodiment 255 is the method, composition for use, or composition of any one of the preceding embodiments, wherein the composition comprises a sequence selected from SEQ ID NOs: 1-149, which is SEQ ID NO: 107.

Embodiment 256 is the method, composition for use, or composition of any one of the preceding embodiments, wherein the composition comprises a sequence selected from SEQ ID NOs: 1-149, which is SEQ ID NO: 108.

Embodiment 257 is the method, composition for use, or composition of any one of the preceding embodiments, wherein the composition comprises a sequence selected from SEQ ID NOs: 1-149, which is SEQ ID NO: 109.

Embodiment 258 is the method, composition for use, or composition of any one of the preceding embodiments, wherein the composition comprises a sequence selected from SEQ ID NOs: 1-149, which is SEQ ID NO: 110.

Embodiment 259 is the method, composition for use, or composition of any one of the preceding embodiments, wherein the composition comprises a sequence selected from SEQ ID NOs: 1-149, which is SEQ ID NO: 111.

Embodiment 260 is the method, composition for use, or composition of any one of the preceding embodiments, wherein the composition comprises a sequence selected from SEQ ID NOs: 1-149, which is SEQ ID NO: 112.

Embodiment 261 is the method, composition for use, or composition of any one of the preceding embodiments, wherein the composition comprises a sequence selected from SEQ ID NOs: 1-149, which is SEQ ID NO: 113.

Embodiment 262 is the method, composition for use, or composition of any one of the preceding embodiments, wherein the composition comprises a sequence selected from SEQ ID NOs: 1-149, which is SEQ ID NO: 114.

Embodiment 263 is the method, composition for use, or composition of any one of the preceding embodiments, wherein the composition comprises a sequence selected from SEQ ID NOs: 1-149, which is SEQ ID NO: 115.

Embodiment 264 is the method, composition for use, or composition of any one of the preceding embodiments, wherein the composition comprises a sequence selected from SEQ ID NOs: 1-149, which is SEQ ID NO: 116.

Embodiment 265 is the method, composition for use, or composition of any one of the preceding embodiments, wherein the composition comprises a sequence selected from SEQ ID NOs: 1-149, which is SEQ ID NO: 117.

Embodiment 266 is the method, composition for use, or composition of any one of the preceding embodiments, wherein the composition comprises a sequence selected from SEQ ID NOs: 1-149, which is SEQ ID NO: 118.

Embodiment 267 is the method, composition for use, or composition of any one of the preceding embodiments, wherein the composition comprises a sequence selected from SEQ ID NOs: 1-149, which is SEQ ID NO: 119.

Embodiment 268 is the method, composition for use, or composition of any one of the preceding embodiments, wherein the composition comprises a sequence selected from SEQ ID NOs: 1-149, which is SEQ ID NO: 120.

Embodiment 269 is the method, composition for use, or composition of any one of the preceding embodiments, wherein the composition comprises a sequence selected from SEQ ID NOs: 1-149, which is SEQ ID NO: 121.

Embodiment 270 is the method, composition for use, or composition of any one of the preceding embodiments, wherein the composition comprises a sequence selected from SEQ ID NOs: 1-149, which is SEQ ID NO: 122.

Embodiment 271 is the method, composition for use, or composition of any one of the preceding embodiments, wherein the composition comprises a sequence selected from SEQ ID NOs: 1-149, which is SEQ ID NO: 123.

Embodiment 272 is the method, composition for use, or composition of any one of the preceding embodiments, wherein the composition comprises a sequence selected from SEQ ID NOs: 1-149, which is SEQ ID NO: 124.

Embodiment 273 is the method, composition for use, or composition of any one of the preceding embodiments, wherein the composition comprises a sequence selected from SEQ ID NOs: 1-149, which is SEQ ID NO: 125.

Embodiment 274 is the method, composition for use, or composition of any one of the preceding embodiments, wherein the composition comprises a sequence selected from SEQ ID NOs: 1-149, which is SEQ ID NO: 126.

Embodiment 275 is the method, composition for use, or composition of any one of the preceding embodiments, wherein the composition comprises a sequence selected from SEQ ID NOs: 1-149, which is SEQ ID NO: 127.

Embodiment 276 is the method, composition for use, or composition of any one of the preceding embodiments, wherein the composition comprises a sequence selected from SEQ ID NOs: 1-149, which is SEQ ID NO: 128.

Embodiment 277 is the method, composition for use, or composition of any one of the preceding embodiments, wherein the composition comprises a sequence selected from SEQ ID NOs: 1-149, which is SEQ ID NO: 129.

Embodiment 278 is the method, composition for use, or composition of any one of the preceding embodiments, wherein the composition comprises a sequence selected from SEQ ID NOs: 1-149, which is SEQ ID NO: 130.

Embodiment 279 is the method, composition for use, or composition of any one of the preceding embodiments, wherein the composition comprises a sequence selected from SEQ ID NOs: 1-149, which is SEQ ID NO: 131.

Embodiment 280 is the method, composition for use, or composition of any one of the preceding embodiments, wherein the composition comprises a sequence selected from SEQ ID NOs: 1-149, which is SEQ ID NO: 132.

Embodiment 281 is the method, composition for use, or composition of any one of the preceding embodiments, wherein the composition comprises a sequence selected from SEQ ID NOs: 1-149, which is SEQ ID NO: 133.

Embodiment 282 is the method, composition for use, or composition of any one of the preceding embodiments, wherein the composition comprises a sequence selected from SEQ ID NOs: 1-149, which is SEQ ID NO: 134.

Embodiment 283 is the method, composition for use, or composition of any one of the preceding embodiments, wherein the composition comprises a sequence selected from SEQ ID NOs: 1-149, which is SEQ ID NO: 135.

Embodiment 284 is the method, composition for use, or composition of any one of the preceding embodiments, wherein the composition comprises a sequence selected from SEQ ID NOs: 1-149, which is SEQ ID NO: 136.

Embodiment 285 is the method, composition for use, or composition of any one of the preceding embodiments, wherein the composition comprises a sequence selected from SEQ ID NOs: 1-149, which is SEQ ID NO: 137.

Embodiment 286 is the method, composition for use, or composition of any one of the preceding embodiments, wherein the composition comprises a sequence selected from SEQ ID NOs: 1-149, which is SEQ ID NO: 138.

Embodiment 287 is the method, composition for use, or composition of any one of the preceding embodiments, wherein the composition comprises a sequence selected from SEQ ID NOs: 1-149, which is SEQ ID NO: 139.

Embodiment 288 is the method, composition for use, or composition of any one of the preceding embodiments, wherein the composition comprises a sequence selected from SEQ ID NOs: 1-149, which is SEQ ID NO: 140.

Embodiment 289 is the method, composition for use, or composition of any one of the preceding embodiments, wherein the composition comprises a sequence selected from SEQ ID NOs: 1-149, which is SEQ ID NO: 141.

Embodiment 290 is the method, composition for use, or composition of any one of the preceding embodiments, wherein the composition comprises a sequence selected from SEQ ID NOs: 1-149, which is SEQ ID NO: 142.

Embodiment 291 is the method, composition for use, or composition of any one of the preceding embodiments, wherein the composition comprises a sequence selected from SEQ ID NOs: 1-149, which is SEQ ID NO: 143.

Embodiment 292 is the method, composition for use, or composition of any one of the preceding embodiments, wherein the composition comprises a sequence selected from SEQ ID NOs: 1-149, which is SEQ ID NO: 144.

Embodiment 293 is the method, composition for use, or composition of any one of the preceding embodiments, wherein the composition comprises a sequence selected from SEQ ID NOs: 1-149, which is SEQ ID NO: 145.

Embodiment 294 is the method, composition for use, or composition of any one of the preceding embodiments, wherein the composition comprises a sequence selected from SEQ ID NOs: 1-149, which is SEQ ID NO: 146.

Embodiment 295 is the method, composition for use, or composition of any one of the preceding embodiments, wherein the composition comprises a sequence selected from SEQ ID NOs: 1-149, which is SEQ ID NO: 147.

Embodiment 296 is the method, composition for use, or composition of any one of the preceding embodiments, wherein the composition comprises a sequence selected from SEQ ID NOs: 1-149, which is SEQ ID NO: 148.

Embodiment 297 is the method, composition for use, or composition of any one of the preceding embodiments, wherein the composition comprises a sequence selected from SEQ ID NOs: 1-149, which is SEQ ID NO: 149.

Embodiment 298 is the method, composition for use, or composition of any one of the preceding embodiments, wherein the guide sequence is selected from SEQ ID NO: 310-386.

Embodiment 299 is the method, composition for use, or composition of any one of the preceding embodiments, wherein the guide sequence is selected from SEQ ID NO: 310-311, 313-326, 329-337, 339-342, 344-346, 348, 350, 352-356, 361, 362, 364, 365, 366, 367, 369-374, 376-380, and 382-386.

Embodiment 300 is the method, composition for use, or composition of any one of the preceding embodiments, wherein the guide sequence selected from SEQ ID NO: 310-386 is SEQ ID NO: 310.

Embodiment 301 is the method, composition for use, or composition of any one of the preceding embodiments, comprising an sgRNA comprising the guide sequence of any one of SEQ ID NOs: 1-149 and any one of the conserved portions of an sgRNA of Table 4, optionally having the modification pattern of SEQ ID NO: 450 or any one of the modification patterns of Table 4, optionally wherein the sgRNA comprises a 5' and 3' end modification.

Embodiment 302 is the method, composition, or composition for use of any one of embodiments 1-301, wherein the composition is administered as a single dose.

Embodiment 303 is the method, composition, or composition for use of any one of embodiments 1-301, wherein the composition is administered one time.

Embodiment 304 is the method, composition, or composition for use of any one of embodiments 302 or 303, wherein the single dose or one time administration:

a. induces a double-stranded break (DSB) within the KLKB1 gene in a cell or subject; and/or
b. reduces expression of the KLKB1 gene in a cell or subject; and/or
c. treats or prevents HAE in a subject; and/or
d. treats or prevents angioedema caused by or associated with HAE in a subject; and/or
e. reduces serum and/or plasma bradykinin concentration in a subject;
f. reduces bradykinin-mediated vasodilation;
g. treats or prevents bradykinin-mediated swelling and angioedema; and/or
h. treats or prevents obstruction of the airway or asphyxiation caused by swelling.

Embodiment 305 is the method or composition of embodiment 304, wherein the single dose or one time administration achieves any one or more of a)-h) for 3, 4, 5, 6, 7, 8, 9, 10, 11, 12, 13, 14, or 15 weeks.

Embodiment 306 is the method or composition of embodiment 304, wherein the single dose or one time administration achieves a durable effect.

Embodiment 307 is the method, composition, or composition for use of any one of embodiments 1-306, further comprising achieving a durable effect.

Embodiment 308 is the method, composition, or composition for use of embodiment 307, wherein the durable effect persists at least 1 month, at least 3 months, at least 6 months, at least one year, or at least 5 years.

Embodiment 309 is the method, composition, or composition for use of any one of embodiments 1-308, wherein administration of the composition results in a therapeutically relevant reduction of kallikrein activity, total plasma kallikrein levels, prekallikrein and/or kallikrein levels, or bradykinin in serum and/or plasma.

Embodiment 310 is the method, composition, or composition for use of any one of embodiments 1-309, wherein administration of the composition results in serum and/or plasma bradykinin levels within a therapeutic range.

Embodiment 311 is the method, composition, or composition for use of any one of the preceding embodiments, wherein administration of the composition results in serum and/or plasma bradykinin levels within 100, 120, or 150% of normal range.

Embodiment 312 is use of a composition of any of the preceding composition embodiments for the preparation of a medicament for treating a human subject having HAE.

Embodiment 313 is use of a composition of any of the preceding composition embodiments for the preparation of a medicament for treating and preventing bradykinin production and accumulation, bradykinin-induced swelling, angioedema obstruction of the airway, or asphyxiation.

Embodiment 314 is use of a composition of any of the preceding composition embodiments for the preparation of a medicament for treating or preventing angioedema caused by or associated with HAE.

Embodiment 315 is use of a composition of any of the preceding composition embodiments for the preparation of a medicament for reducing the frequency of angioedema attacks.

Embodiment 316 is use of a composition of any of the preceding composition embodiments for the preparation of a medicament for reducing the severity of angioedema attacks.

Embodiment 317 is use of a composition of any of the preceding composition embodiments for the preparation of a medicament for reducing the frequency and/or severity of HAE attacks.

Embodiment 318 is use of a composition of any of the preceding composition embodiments for the preparation of a medicament for achieving remission of angioedema attacks.

Embodiment 319 is use of a composition of any of the preceding composition embodiments for the preparation of a medicament for achieving durable remission, e.g. maintained for at least 1 month, 2 months, 4 months, 6 months, 1 year, 2 years, 5 years, 10 years or more.

DETAILED DESCRIPTION

Figure 1A:
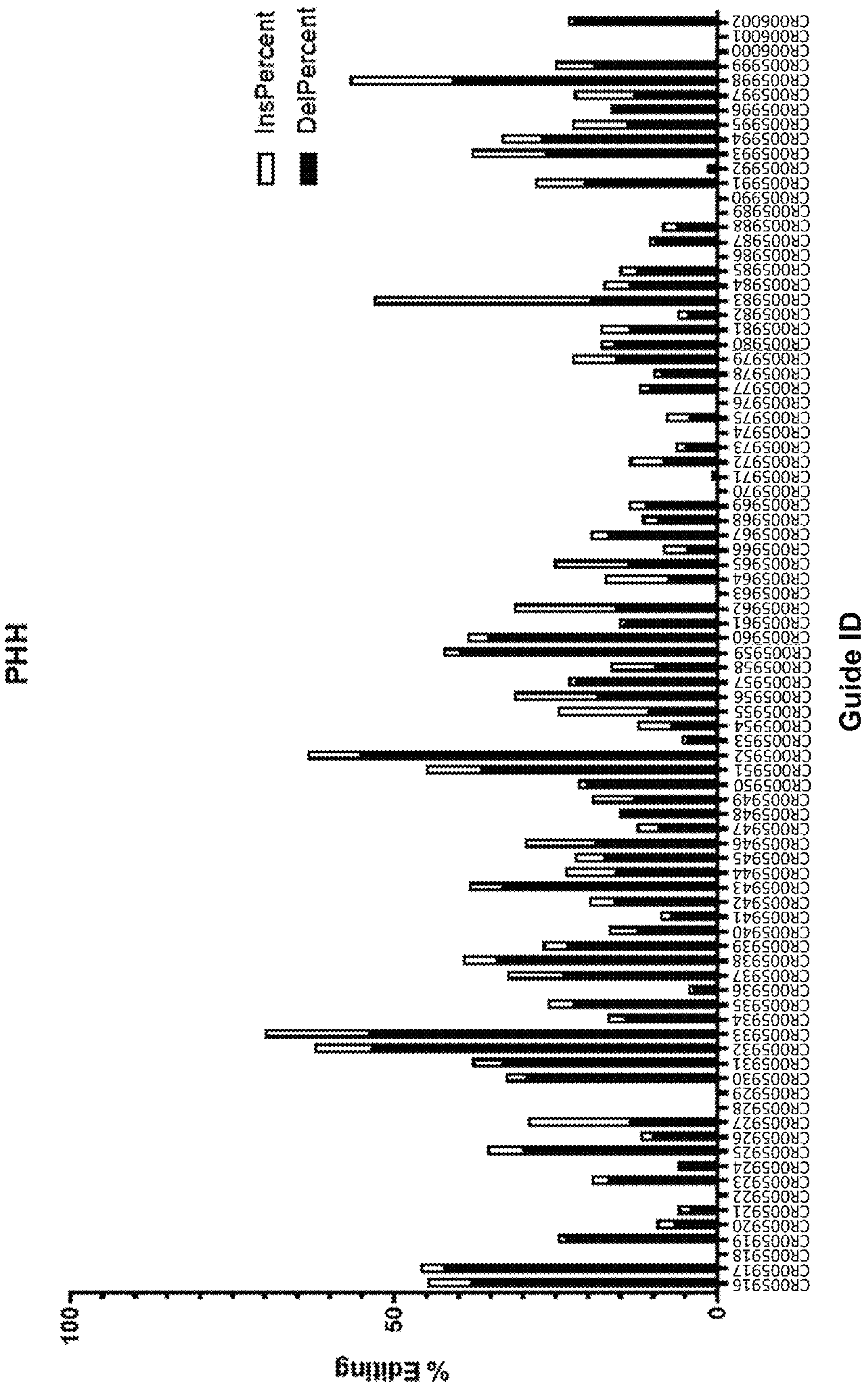
FIGS. 1A-1D show percent editing (indel frequency) detected at various sites within the KLKB1 locus using guide RNAs in primary human hepatocytes (PHH) (FIGS. 1A-1B) and primary cynomolgus hepatocytes (PCH) (FIGS. 1C-1D).

Reference will now be made in detail to certain embodiments of the invention, examples of which are illustrated in the accompanying drawings. While the invention is described in conjunction with the illustrated embodiments, it will be understood that they are not intended to limit the invention to those embodiments. On the contrary, the invention is intended to cover all alternatives, modifications, and equivalents, which may be included within the invention as defined by the appended claims and included embodiments.

Before describing the present teachings in detail, it is to be understood that the disclosure is not limited to specific compositions or process steps, as such may vary. It should be noted that, as used in this specification and the appended claims, the singular form "a", "an" and "the" include plural references unless the context clearly dictates otherwise. Thus, for example, reference to "a conjugate" includes a plurality of conjugates and reference to "a cell" includes a plurality of cells and the like.

Numeric ranges are inclusive of the numbers defining the range. Measured and measurable values are understood to be approximate, taking into account significant digits and the error associated with the measurement. Also, the use of "comprise", "comprises", "comprising", "contain", "contains", "containing", "include", "includes", and "including" are not intended to be limiting. It is to be understood that both the foregoing general description and detailed description are exemplary and explanatory only and are not restrictive of the teachings.

Unless specifically noted in the specification, embodiments in the specification that recite "comprising" various components are also contemplated as "consisting of" or "consisting essentially of" the recited components; embodiments in the specification that recite "consisting of" various components are also contemplated as "comprising" or "consisting essentially of" the recited components; and embodiments in the specification that recite "consisting essentially of" various components are also contemplated as "consisting of" or "comprising" the recited components (this interchangeability does not apply to the use of these terms in the claims).

The term "or" is used in an inclusive sense, i.e., equivalent to "and/or," unless the context clearly indicates otherwise.

The section headings used herein are for organizational purposes only and are not to be construed as limiting the desired subject matter in any way. In the event that any material incorporated by reference contradicts any term defined in this specification or any other express content of this specification, this specification controls. While the present teachings are described in conjunction with various embodiments, it is not intended that the present teachings be limited to such embodiments. On the contrary, the present teachings encompass various alternatives, modifications, and equivalents, as will be appreciated by those of skill in the art.

I. Definitions

Unless stated otherwise, the following terms and phrases as used herein are intended to have the following meanings:

"Polynucleotide" and "nucleic acid" are used herein to refer to a multimeric compound comprising nucleosides or nucleoside analogs which have nitrogenous heterocyclic bases or base analogs linked together along a backbone, including conventional RNA, DNA, mixed RNA-DNA, and polymers that are analogs thereof. A nucleic acid "backbone" can be made up of a variety of linkages, including one or more of sugar-phosphodiester linkages, peptide-nucleic acid bonds ("peptide nucleic acids" or PNA; PCT Publication No. WO 95/32305), phosphorothioate linkages, methylphosphonate linkages, or combinations thereof. Sugar moieties of a nucleic acid can be ribose, deoxyribose, or similar compounds with substitutions, e.g., 2' methoxy or 2' halide substitutions. Nitrogenous bases can be conventional bases (A, G, C, T, U), analogs thereof (e.g., modified uridines such as 5-methoxyuridine, pseudouridine, or N1-methylpseudouridine, or others); inosine; derivatives of purines or pyrimidines (e.g., $N^4$-methyl deoxyguanosine, deaza- or aza-purines, deaza- or aza-pyrimidines, pyrimidine bases with substituent groups at the 5 or 6 position (e.g., 5-methylcytosine), purine bases with a substituent at the 2, 6, or 8 positions, 2-amino-6-methylaminopurine, $O^6$-methylguanine, 4-thio-pyrimidines, 4-amino-pyrimidines, 4-dimethylhydrazine-pyrimidines, and $O^4$-alkyl-pyrimidines; U.S. Pat. No. 5,378,825 and PCT Publication No. WO 93/13121). For general discussion see *The Biochemistry of the Nucleic Acids* 5-36, Adams et al., ed., $11^{th}$ ed., 1992). Nucleic acids can include one or more "abasic" residues where the backbone includes no nitrogenous base for position(s) of the polymer (U.S. Pat. No. 5,585,481). A nucleic acid can comprise only conventional RNA or DNA sugars, bases and linkages, or can include both conventional components and substitutions (e.g., conventional bases with 2' methoxy linkages, or polymers containing both conventional bases and one or more base analogs). Nucleic acid includes "locked nucleic acid" (LNA), an analogue containing one or more LNA nucleotide monomers with a bicyclic furanose unit locked in an RNA mimicking sugar conformation, which enhance hybridization affinity toward complementary RNA and DNA sequences (Vester and Wengel, 2004, *Biochemistry* 43(42):13233-41). RNA and DNA have different sugar moieties and can differ by the presence of uracil or analogs thereof in RNA and thymine or analogs thereof in DNA.

"Guide RNA", "gRNA", and simply "guide" are used herein interchangeably to refer to the guide that directs an RNA-guided DNA binding agent to a target DNA and can be either a crRNA (also known as CRISPR RNA), or the combination of a crRNA and a trRNA (also known as tracrRNA). The crRNA and trRNA may be associated as a single RNA molecule (single guide RNA, sgRNA) or in two separate RNA molecules (dual guide RNA, dgRNA). "Guide RNA" or "gRNA" refers to each type. The trRNA may be a naturally-occurring sequence, or a trRNA sequence with modifications or variations compared to naturally-occurring sequences.

As used herein, a "guide sequence" refers to a sequence within a guide RNA that is complementary to a target sequence and functions to direct a guide RNA to a target sequence for binding or modification (e.g., cleavage) by an RNA-guided DNA binding agent. A "guide sequence" may also be referred to as a "targeting sequence," or a "spacer sequence." A guide sequence can be 20 base pairs in length, e.g., in the case of *Streptococcus pyogenes* (i.e., Spy Cas9) and related Cas9 homologs/orthologs. Shorter or longer sequences can also be used as guides, e.g., 15-, 16-, 17-, 18-, 19-, 21-, 22-, 23-, 24-, or 25-nucleotides in length. For example, in some embodiments, the guide sequence comprises at least 17, 18, 19, or 20 contiguous nucleotides of a sequence selected from SEQ ID NOs: 1-149. In some embodiments, the target sequence is in a gene or on a chromosome, for example, and is complementary to the guide sequence. In some embodiments, the degree of complementarity or identity between a guide sequence and its corresponding target sequence may be about 75%, 80%, 85%, 90%, 95%, 96%, 97%, 98%, 99%, or 100%. For example, in some embodiments, the guide sequence comprises a sequence with about 75%, 80%, 85%, 90%, 95%, 96%, 97%, 98%, 99%, or 100% identity to at least 17, 18, 19, or 20 contiguous nucleotides of a sequence selected from SEQ ID NOs: 1-149. In some embodiments, the guide sequence and the target region may be 100% complementary or identical. In other embodiments, the guide sequence and the target region may contain at least one mismatch. For example, the guide sequence and the target sequence may contain 1, 2, 3, or 4 mismatches, where the total length of the target sequence is at least 17, 18, 19, 20 or more base pairs. In some embodiments, the guide sequence and the target region may contain 1-4 mismatches where the guide sequence comprises at least 17, 18, 19, 20 or more nucleotides. In some embodiments, the guide sequence and the target region may contain 1, 2, 3, or 4 mismatches where the guide sequence comprises 20 nucleotides.

Target sequences for RNA-guided DNA binding agents include both the positive and negative strands of genomic DNA (i.e., the sequence given and the sequence's reverse compliment), as a nucleic acid substrate for an RNA-guided DNA binding agent is a double stranded nucleic acid. Accordingly, where a guide sequence is said to be "complementary to a target sequence", it is to be understood that the guide sequence may direct a guide RNA to bind to the reverse complement of a target sequence. Thus, in some embodiments, where the guide sequence binds the reverse complement of a target sequence, the guide sequence is identical to certain nucleotides of the target sequence (e.g., the target sequence not including the PAM) except for the substitution of U for T in the guide sequence.

As used herein, an "RNA-guided DNA binding agent" means a polypeptide or complex of polypeptides having RNA and DNA binding activity, or a DNA-binding subunit of such a complex, wherein the DNA binding activity is sequence-specific and depends on the sequence of the RNA. Exemplary RNA-guided DNA binding agents include Cas cleavases/nickases and inactivated forms thereof ("dCas DNA binding agents"). "Cas nuclease", also called "Cas protein" as used herein, encompasses Cas cleavases, Cas nickases, and dCas DNA binding agents. Cas cleavases/nickases and dCas DNA binding agents include a Csm or Cmr complex of a type III CRISPR system, the Cas10, Csm1, or Cmr2 subunit thereof, a Cascade complex of a type I CRISPR system, the Cas3 subunit thereof, and Class 2 Cas nucleases. As used herein, a "Class 2 Cas nuclease" is a single-chain polypeptide with RNA-guided DNA binding activity. Class 2 Cas nucleases include Class 2 Cas cleavases/nickases (e.g., H840A, D10A, or N863A variants), which further have RNA-guided DNA cleavases or nickase activity, and Class 2 dCas DNA binding agents, in which cleavase/nickase activity is inactivated. Class 2 Cas nucleases include, for example, Cas9, Cpf1, C2c1, C2c2, C2c3, HF Cas9 (e.g., N497A, R661A, Q695A, Q926A variants), HypaCas9 (e.g., N692A, M694A, Q695A, H698A variants), eSPCas9(1.0) (e.g., K810A, K1003A, R1060A variants), and eSPCas9(1.1) (e.g., K848A, K1003A, R1060A variants) proteins and modifications thereof. Cpf1 protein, Zetsche et al., *Cell,* 163: 1-13 (2015), is homologous to Cas9, and contains a RuvC-like nuclease domain. Cpf1 sequences of Zetsche are incorporated by reference in their entirety. See, e.g., Zetsche, Tables S1 and S3. See, e.g., Makarova et al., *Nat Rev Microbiol,* 13(11): 722-36 (2015); Shmakov et al., *Molecular Cell,* 60:385-397 (2015).

As used herein, "ribonucleoprotein" (RNP) or "RNP complex" refers to a guide RNA together with an RNA-guided DNA binding agent, such as a Cas nuclease, e.g., a Cas cleavase, Cas nickase, or dCas DNA binding agent (e.g., Cas9). In some embodiments, the guide RNA guides the RNA-guided DNA binding agent such as Cas9 to a target sequence, and the guide RNA hybridizes with and the agent binds to the target sequence; in cases where the agent is a cleavase or nickase, binding can be followed by cleaving or nicking.

As used herein, a first sequence is considered to "comprise a sequence with at least X % identity to" a second sequence if an alignment of the first sequence to the second sequence shows that X % or more of the positions of the second sequence in its entirety are matched by the first sequence. For example, the sequence AAGA comprises a sequence with 100% identity to the sequence AAG because an alignment would give 100% identity in that there are matches to all three positions of the second sequence. The differences between RNA and DNA (generally the exchange of uridine for thymidine or vice versa) and the presence of nucleoside analogs such as modified uridines do not contribute to differences in identity or complementarity among polynucleotides as long as the relevant nucleotides (such as thymidine, uridine, or modified uridine) have the same complement (e.g., adenosine for all of thymidine, uridine, or modified uridine; another example is cytosine and 5-methylcytosine, both of which have guanosine or modified guanosine as a complement). Thus, for example, the sequence 5'-AXG where X is any modified uridine, such as pseudouridine, N1-methyl pseudouridine, or 5-methoxyuridine, is considered 100% identical to AUG in that both are perfectly complementary to the same sequence (5'-CAU). Exemplary alignment algorithms are the Smith-Waterman and Needleman-Wunsch algorithms, which are well-known in the art. One skilled in the art will understand what choice of algorithm and parameter settings are appropriate for a given pair of sequences to be aligned; for sequences of generally similar length and expected identity >50% for amino acids or >75% for nucleotides, the Needleman-Wunsch algorithm with default settings of the Needleman-Wunsch algorithm interface provided by the EBI at the www.ebi.ac.uk web server is generally appropriate.

"mRNA" is used herein to refer to a polynucleotide and comprises an open reading frame that can be translated into a polypeptide (i.e., can serve as a substrate for translation by a ribosome and amino-acylated tRNAs). mRNA can comprise a phosphate-sugar backbone including ribose residues or analogs thereof, e.g., 2'-methoxy ribose residues. In some embodiments, the sugars of an mRNA phosphate-sugar backbone consist essentially of ribose residues, 2'-methoxy ribose residues, or a combination thereof.

Guide sequences useful in the guide RNA compositions and methods described herein are shown in Table 1 or Table 2 and throughout the application.

As used herein, "indels" refer to insertion/deletion mutations consisting of a number of nucleotides that are either inserted or deleted at the site of double-stranded breaks (DSBs) in a target nucleic acid.

As used herein, "knockdown" refers to a decrease in expression of a particular gene product (e.g., protein, mRNA, or both). Knockdown of a protein can be measured by detecting the total cellular amount of the protein from a sample, such as a tissue, fluid, or cell population of interest. It can also be measured by measuring a surrogate, marker, or activity for the protein. Methods for measuring knockdown of mRNA are known and include sequencing of mRNA isolated from a sample of interest. In some embodiments, "knockdown" may refer to some loss of expression of a particular gene product, for example a decrease in the amount of mRNA transcribed or a decrease in the amount of protein expressed by a population of cells (including in vivo populations such as those found in tissues).

As used herein, "knockout" refers to a loss of expression from a particular gene or of a particular protein in a cell. Knockout can be measured either by detecting the total cellular amount of a protein in a cell, a tissue or a population of cells. In some embodiments, the methods of the invention "knockout" KLKB1 in one or more samples, e.g., serum, plasma, tissue, or cells (e.g., in a population of cells including in vivo populations such as those found in tissues). In some embodiments, a knockout is not the formation of mutant KLKB1 protein, for example, created by indels, but rather the complete loss of expression of KLKB1 protein in a cell. As used herein, "KLKB1" generally refers to prekallikrein, which is the gene product of a KLKB1 gene. Prekallikrein is processed to plasma kallikrein (pKal), and antibodies can detect pKal, prekallikrein, or both. The human wild-type KLKB1 sequence is available at NCBI Gene ID: 3818; Ensembl: ENSG00000164344. "PKK," "PPK," "KLK3," and "PKKD" are gene synonyms. The human KLKB1 transcript is available at Ensembl: ENST00000264690, and the cynomolgus wild-type KLKB1 sequence is available at Ensembl: ENSMFAT00000002355.

"Hereditary Angioedema" (HAE) is an inflammatory disorder characterized by recurrent episodes of severe swelling (angioedema), due to inactivating mutations of the SERPING1 gene, which encodes the C1 esterase inhibitor protein (C1-INH). C1-INH blocks the activity of certain proteins that promote inflammation (e.g., in Kinin system). Deficient levels of C1-INH leads to unchecked Factor XII (FXII) and high level of activation of kallikrein (pKal, processed from KLKB1 protein (prekallikrein)). Kallikrein cleaves high-molecular weight kininogen (HMWK) to release bradykinin, a peptide that impacts vascular permeability. Excessive amounts of bradykinin in the blood leads to fluid leakage through the walls of blood vessels into body tissues, causing swelling seen in individuals with HAE. Thus, in some embodiments, methods for decreasing KLKB1 activity are provided, wherein once reduced, bradykinin production is decreased and swelling attacks are reduced. Protein levels of prekallikrein/kallikrein, HMWK and its cleavage products, and surrogate labeled substrates of HMWK may be measured to assess efficacy of KLKB1 knockout.

As used herein, a "target sequence" refers to a sequence of nucleic acid in a target gene that has complementarity to the guide sequence of the gRNA. The interaction of the target sequence and the guide sequence directs an RNA-guided DNA binding agent to bind, and potentially nick or cleave (depending on the activity of the agent), within the target sequence.

Figure 14:
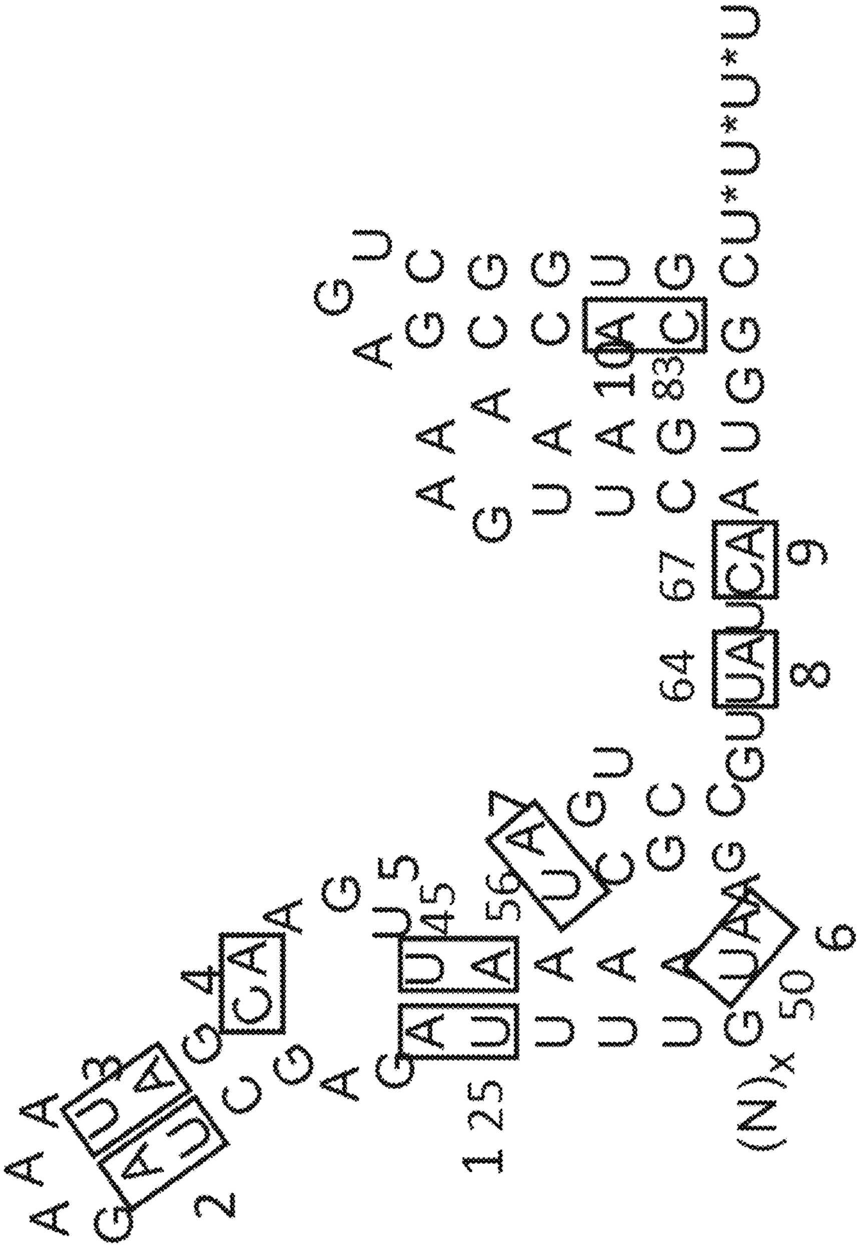
FIG. 14 labels the 10 conserved region YA sites in an exemplary sgRNA sequence (SEQ ID NO: 201) from 1 to 10. The numbers 25, 45, 50, 56, 64, 67, and 83 indicate the position of the pyrimidine of YA sites 1, 5, 6, 7, 8, 9, and 10 in an sgRNA with a guide region indicated as (N)x, e.g., wherein x is optionally 20.
Figure 15:
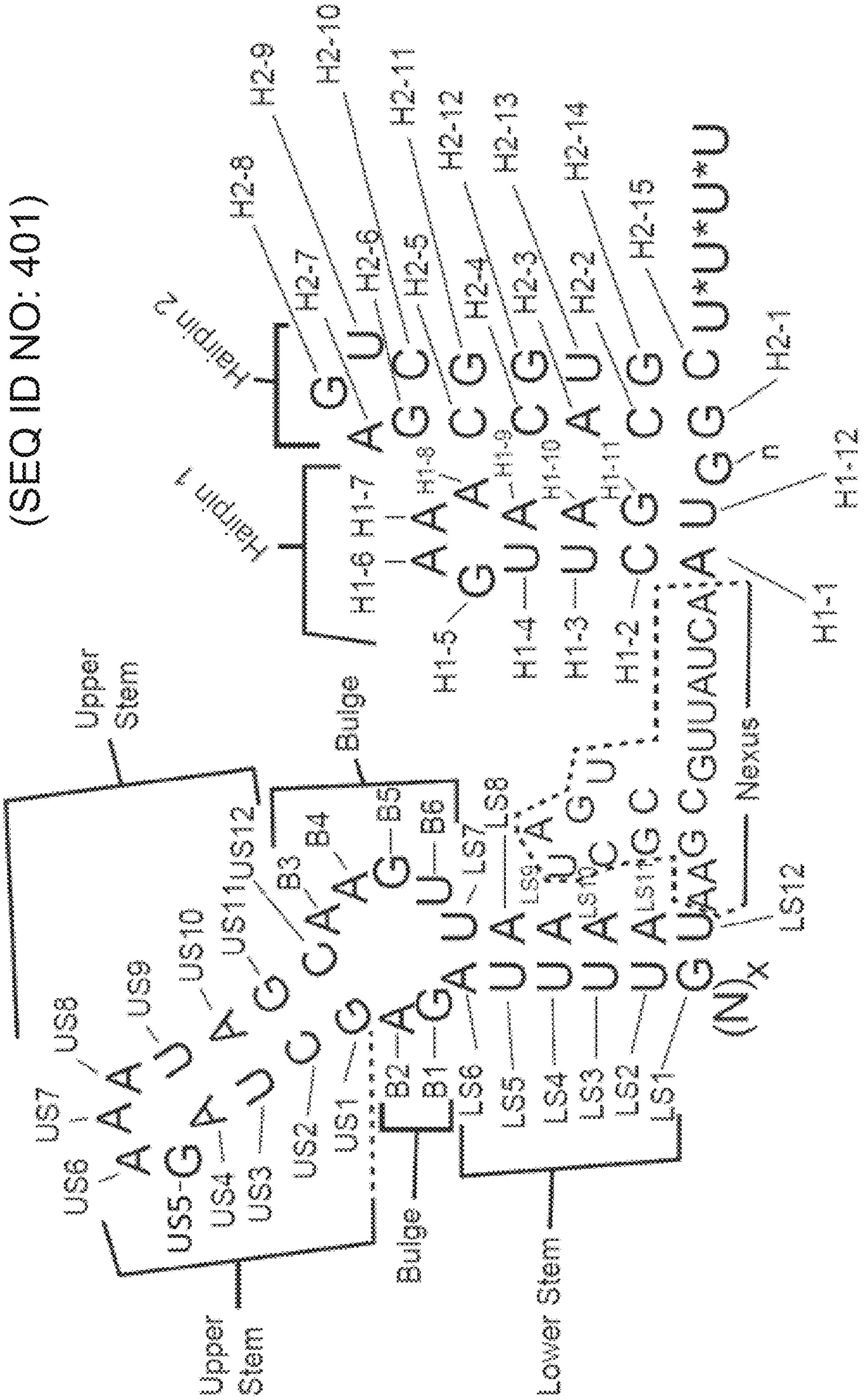
FIG. 15 shows an exemplary sgRNA (SEQ ID NO: 401; not all modifications are shown) in a possible secondary structure with labels designating individual nucleotides of the conserved region of the sgRNA, including the lower stem, bulge, upper stem, *nexus* (the nucleotides of which can be referred to as N1 through N18, respectively, in the 5' to 3' direction), hairpin 1, and hairpin 2 regions. A nucleotide between hairpin 1 and hairpin 2 is labeled n. A guide region may be present on an sgRNA and is indicated in this figure as "(N)x" preceding the conserved region of the sgRNA.

As used herein, a "YA site" refers to a 5'-pyrimidine-adenine-3' dinucleotide. A "conserved region YA site" is present in the conserved region of an sgRNA. A "guide region YA site" is present in the guide region of an sgRNA. An unmodified YA site in an sgRNA may be susceptible to cleavage by RNase A-like endonucleases, e.g., RNase A. In some embodiments, an sgRNA comprises about 10 YA sites in its conserved region. In some embodiments, an sgRNA comprises 1, 2, 3, 4, 5, 6, 7, 8, 9, or 10 YA sites in its conserved region. Exemplary conserved region YA sites are indicated in FIG. 14 (SEQ ID NO: 201), in relation to an sgRNA structure (FIG. 15). Exemplary guide region YA sites are not shown in FIG. 14, as the guide region may be any sequence, including any number of YA sites. In some embodiments, an sgRNA comprises 1, 2, 3, 4, 5, 6, 7, 8, 9, or 10 of the YA sites indicated in FIG. 14. In some embodiments, an sgRNA comprises 1, 2, 3, 4, 5, 6, 7, 8, 9, or 10 YA sites at the following positions or a subset thereof: LS5-LS6; US3-US4; US9-US10; US12-B3; LS7-LS8; LS12-N1; N6-N7; N14-N15; N17-N18; and H2-2 to H2-3. In some embodiments, a YA site comprises a modification, meaning that at least one nucleotide of the YA site is modified. In some embodiments, the pyrimidine (also called the pyrimidine position) of the YA site comprises a modification (which includes a modification altering the internucleoside linkage immediately 3' of the sugar of the pyrimidine). In some embodiments, the adenine (also called the adenine position) of the YA site comprises a modification (which includes a modification altering the internucleoside linkage immediately 3' of the sugar of the adenine). In some embodiments, the pyrimidine position and the adenine position of the YA site comprise modifications.

As used herein, "treatment" refers to any administration or application of a therapeutic for disease or disorder in a subject, and includes inhibiting the disease, arresting its development, relieving one or more symptoms of the disease, curing the disease, or preventing reoccurrence of one or more symptoms of the disease. For example, treatment of HAE may comprise alleviating symptoms of HAE.

The term "therapeutically relevant reduction of KLKB1 activity," can mean a greater than about 60% reduction of plasma KLKB1 activity as compared to baseline. See, Banerji et al., N Engl J Med, 2017, 376:717-728; Ferrone et al., Nucleic Acid Therapeutics, 2019, 82-917. KLKB1 activity is often measured as total kallikrein activity, in which prekallikrein is converted to kallikrein in a sample and total kallikrein activity is measured for the sample. In some instances, a range of KLKB1 activity reduction can mean about 60-80% reduction of plasma KLKB1 activity as compared to baseline. To calculate reduction of an analyte in a subject, a basal value can be obtained by collecting a pretreatment sample from the subject. In some instances, the sample is a serum sample. In certain aspects, the target KLKB1 activity reduction is about a 60% reduction in total kallikrein (prekallikrein and plasma kallikrein) activity as compared to baseline. For example, achieving KLKB1 activity levels within a therapeutic range can mean reducing total kallikrein by about >60% from baseline. In some embodiments, a "normal kallikrein level" or a "normal kallikrein range" is reduced. In some embodiments, a therapeutically relevant reduction of kallikrein activity achieves levels of about 0-60%, 0-50%, 0-40%, 0-30%, 0-25%, 0-20%, 0-15%, 0-10% of a basal value for the subject, or 10-60%, 10-50%, 10-40%, 10-30%, 10-20%, or 20-60%, 20-50%, 20-40%, or 20-30%%, of normal kallikrein activity level. KLKB1 activity can be measured by assays known in the field, including assays described herein.

The term "target KLKB1 protein reduction," as used herein, means the target level of pKal as compared to baseline. KLKB1 protein levels can be measured by assays known in the field such as ELISA or western blot assays, as described herein. Total KLKB1 protein can be measured with an antibody that detects both prekallikrein and kallikrein and/or after converting prekallikrein to kallikrein in a sample. In some instances, the sample is a serum sample. In certain aspects, the target KLKB1 protein reduction is about a 60% reduction in total kallikrein (prekallikrein and plasma kallikrein) as compared to baseline. In some embodiments, a therapeutically relevant reduction of total kallikrein protein achieves levels of about 0-60%, 0-50%, 0-40%, 0-30%, 0-25%, 0-20%, 0-15%, 0-10% of a basal value for the subject, or 10-60%, 10-50%, 10-40%, 10-30%, 10-20%, or 20-60%, 20-50%, 20-40%, or 20-30%%, of normal total kallikrein protein level.

Circulating plasma cHMWK levels below about 30% total HMWK were associated with decreases in HAE attacks in patients treated with lanadelumab (See Banerji, et al, 2017). In this same study, healthy controls had plasma levels of cHMWK around 8.3% total HMWK. In another study, Suffriti and colleagues found cHMWK plasma levels of an average of about 34.8% in normal controls, about 41.4% in HAE patients in remission and about 58.1% in HAE patients during an attack (Suffritti, et al. Clin Exp Allergy 2014; 44:1503-14). Therapeutic treatment can target a ratio of circulating plasma cHMWK to total HMWK of less than about 60%. In some embodiments the ratio of cHMWK to HMWK is less than about 10%, 15%, 20%, 25%, 30%, 35%, 40%, 50%, or more.

The term "about" or "approximately" means an acceptable error for a particular value as determined by one of ordinary skill in the art, which depends in part on how the value is measured or determined.

II. Compositions

A. Compositions Comprising Guide RNA (gRNAs)

Provided herein are compositions useful for inducing a double-stranded break (DSB), single-strand break, and/or site-specific binding that results in nucleic acid modification within the KLKB1 gene, e.g., using a guide RNA with an RNA-guided DNA binding agent (e.g., a CRISPR/Cas system). The compositions may be administered to subjects having or suspected of having HAE. The compositions may be administered to subjects having increased serum and/or plasma bradykinin concentration as measured, for example, by a decrease in prekallikrein protein levels in the plasma or serum, by a decrease in total kallikrein (prekallikrein and pKal) protein levels in plasma or serum, by a decrease in the proportion of circulating cleaved HMWK (cHMWK), or by a decrease in the proportion of cHMWK in citrated plasma. The compositions may be administered to subjects having increased serum and/or plasma prekallikrein and/or kallikrein concentration. The compositions may be administered to subjects having increased serum and/or plasma total kallikrein concentration. The compositions may be administered to subjects having increased serum and/or plasma kallikrein activity. Guide sequences targeting the KLKB1 gene are shown in Table 1 at SEQ ID NOs: 1-149.

Each of the guide sequences shown in Table 1 at SEQ ID NOs: 1-149 may further comprise additional nucleotides to form a crRNA, e.g., with the following exemplary nucleotide sequence following the guide sequence at its 3' end: GUUJUUAGAGCUAUGCUGUUUUG (SEQ ID NO: 167) in 5' to 3' orientation. In the case of an sgRNA, the above guide sequences may further comprise additional nucleotides to form an sgRNA, e.g., with the following exemplary nucleotide sequence following the 3' end of the guide sequence: GUUUUAGAGCUA-GAAAUAGCAAGUUAAAAUAAGGCUAGU-CCGUUAUCAACUU GAAAAAGUGGCACCGAGUCG-GUGCUUUU (SEQ ID NO: 171) or GUUUUAGAGCUA-GAAAUAGCAAGUUAAAAUAAGGCUAGU-CCGUUAUCAACUU GAAAAAGUGGCACCGAGUCG-GUGC (SEQ ID NO: 172, which is SEQ ID NO: 171 without the four terminal U's) in 5' to 3' orientation. In some embodiments, the four terminal U's of SEQ ID NO: 171 are not present. In some embodiments, only 1, 2, or 3 of the four terminal U's of SEQ ID NO: 171 are present.

In some embodiments, the sgRNA comprises any one of the guide sequences of SEQ ID Nos: 1-149 and additional nucleotides to form a crRNA, e.g., with the following exemplary nucleotide sequence following the guide sequence at its 3' end: GUUUUAGAGCUA-GAAAUAGCAAGUUAAAAUAAGGCUAGU-CCGUUAUCAACUU GGCACCGAGUCGGUGCU UUU (SEQ ID NO: 170) or GUUUUAGAGCUA-GAAAUAGCAAGUUAAAAUAAGGCUAGU-CCGUUAUCAACUU GGCACCGAGUCGGUGC (SEQ ID NO: 173) in 5' to 3' orientation. SEQ ID NO: 173 lacks 8 nucleotides with reference to a wild-type guide RNA conserved sequence:

(SEQ ID NO: 172)
GUUUUAGAGCUAGAAAUAGCAAGUUAAAAUAAGGCUAGUCCGUUAUCAAC

UUGAAAAAGUGGCACCGAGUCGGUGC.

In some embodiments, KLKB1 short-single guide RNAs (KLKB1 short-sgRNAs) are provided comprising a guide sequence as described herein and a "conserved portion of an sgRNA" comprising a hairpin region, wherein the hairpin region lacks at least 5-10 nucleotides or 6-10 nucleotides. In certain embodiments, a hairpin region of the KLKB1 short-single guide RNAs lacks 5-10 nucleotides with reference to the conserved portion of an sgRNA, e.g. nucleotides H1-1 to H2-15 in Table 3B and FIG. 15. In certain embodiments, a hairpin 1 region of the KLKB1 short-single guide RNAs lacks 5-10 nucleotides with reference to the conserved portion of an sgRNA, e.g. nucleotides H1-1 to H1-12 in Table 3B and FIG. 15. See, e.g., WO 2019/237069, the contents of which is hereby incorporated by reference in its entirety, for example, at claims 1-15.

An exemplary "conserved portion of an sgRNA" is shown in Table 3A (see also FIG. 15), which shows a "conserved region" of an *S. pyogenes* Cas9 ("spyCas9" (also referred to as "spCas9")) sgRNA. The first row shows the numbering of the nucleotides, the second row shows the sequence (SEQ ID NO: 500); and the third row shows "domains." Briner A E et al., *Molecular Cell* 56:333-339 (2014) describes functional domains of sgRNAs, referred to herein as "domains", including the "spacer" domain responsible for targeting, the "lower stem", the "bulge", "upper stem" (which may include a tetraloop), the "*nexus*", and the "hairpin 1" and "hairpin 2" domains. See, Briner et al. at page 334, FIG. 1A.

Table 3B provides a schematic of the domains of an sgRNA as used herein. In Table 3B, the "n" between regions represents a variable number of nucleotides, for example, from 0 to 1, 2, 3, 4, 5, 6, 7, 8, 9, 10, 11, 12, 13, 14, 15, 16, 17, 18, 19, 20, or more. In some embodiments, n equals 0. In some embodiments, n equals 1.

In some embodiments, the KLKB1 sgRNA is from *S. pyogenes* Cas9 ("spyCas9") or a spyCas9 equivalent. In some embodiments, the sgRNA is not from *S. pyogenes* ("non-spyCas9"). In some embodiments, the 5-10 nucleotides or 6-10 nucleotides are consecutive.

In some embodiments, a KLKB1 short-sgRNA lacks at least nucleotides 54-58 (AAAAA) of the conserved portion of an *S. pyogenes* Cas9 ("spyCas9") sgRNA, as shown in Table 3A. In some embodiments, a KLKB1 short-sgRNA is a non-spyCas9 sgRNA that lacks at least nucleotides corresponding to nucleotides 54-58 (AAAAA) of the conserved portion of a spyCas9 as determined, for example, by pairwise or structural alignment. In some embodiments, the non-spyCas9 sgRNA is *Staphylococcus aureus* Cas9 ("saCas9") sgRNA.

In some embodiments, a KLKB1 short-sgRNA lacks at least nucleotides 54-61 (AAAAAGUG) of the conserved portion of a spyCas9 sgRNA. In some embodiments, a KLKB1 short-sgRNA lacks at least nucleotides 53-60

(GAAAAAGU) of the conserved portion of a spyCas9 sgRNA. In some embodiments, a KLKB1 short-sgRNA lacks 4, 5, 6, 7, or 8 nucleotides of nucleotides 53-60 (GAAAAAGU) or nucleotides 54-61 (AAAAAGUG) of the conserved portion of a spyCas9 sgRNA, or the corresponding nucleotides of the conserved portion of a non-spyCas9 sgRNA as determined, for example, by pairwise or structural alignment.

TABLE 1

Human KLKB1 targeted guide sequence, chromosomal coordinates, and human single guide RNAs and dual guide RNAs, and surrogate cynomolgus (cyno) monkey single guides

| SEQ ID NO: (human) | Exemplary Genomic Coordinates (hg38) | human guide sequence | human sgRNA | human dgRNA | cyno sgRNA | Cyno guide SEQ ID NO: |
|---|---|---|---|---|---|---|
| 1 | chr4: 186228230-186228252 | ACAGGAAACUGUAGCAAACA | G012253 | CR005916 | NA | NA |
| 2 | chr4: 186228248-186228270 | AUAGAUAAUUCACUUACCAC | G012254 | CR005917 | NA | NA |
| 3 | chr4: 186232154-186232176 | UACAUCCCCACCUCUGAAGA | G012255 | CR005918 | NA | NA |
| 4 | chr4: 186251256-186251278 | UCUUGAGGAGUAGAGGAACU | G012256 | CR005922 | NA | NA |
| 5 | chr4: 186251308-186251330 | ACCAGGUAAAGUUCUUUUGC | G012257 | CR005924 | NA | NA |
| 6 | chr4: 186251489-186251511 | GGGUAAAUUUUAGAAUGGCA | G012258 | CR005925 | NA | NA |
| 7 | chr4: 186251504-186251526 | AUUUACCCGGGAGUUGACUU | G012259 | CR005928 | NA | NA |
| 8 | chr4: 186251507-186251529 | UACCCGGGAGUUGACUUUGG | G012260 | CR005929 | NA | NA |
| 9 | chr4: 186251828-186251850 | UCUUUGAGAUUGUGUAACAC | G012261 | CR005931 | NA | NA |
| 10 | chr4: 186251829-186251851 | CUUUGAGAUUGUGUAACACU | G012262 | CR005932 | NA | NA |
| 11 | chr4: 186251830-186251852 | UUUGAGAUUGUGUAACACUG | G012263 | CR005933 | NA | NA |
| 12 | chr4: 186254748-186254770 | UACAUACCAGUGUAAUUCAA | G012264 | CR005943 | NA | NA |
| 13 | chr4: 186251784-186251806 | CUCCAACUAGGAUUGCGUAU | G012265 | CR005949 | G013933 | 373 |
| 14 | chr4: 186251792-186251814 | AGGAUUGCGUAUGGGACACA | G012266 | CR005951 | G013904 | 344 |
| 15 | chr4: 186251793-186251815 | GGAUUGCGUAUGGGACACAA | G012267 | CR005952 | G013901 | 341 |
| 16 | chr4: 186238297-186238319 | GUUACUCAGCACCUUUAUAG | G012268 | CR005956 | G013945 | 385 |
| 17 | chr4: 186238263-186238285 | UGCCUAUUAAAGUACAGUCC | G012269 | CR005959 | NA | NA |
| 18 | chr4: 186251772-186251794 | CUAUGGAUGGUUCUCCAACU | G012270 | CR005960 | G013922 | 362 |
| 19 | chr4: 186254601-186254623 | GAUGUUUGGCGCAUCUAUAG | G012271 | CR005963 | G013921 | 361 |
| 20 | chr4: 186254592-186254614 | AUGCGCCAAACAUCCUGCAG | G012272 | CR005970 | G013885 | 325 |
| 21 | chr4: 186236785-186236807 | CUCCUUUAUAAAUGUCUCGA | G012273 | CR005979 | G013905 | 345 |
| 22 | chr4: 186236863-186236885 | UGUUACUGGUGCACCUUUUU | G012274 | CR005982 | NA | NA |
| 23 | chr4: 186254593-186254615 | GAUGCGCCAAACAUCCUGCA | G012275 | CR005983 | G013876 | 316 |
| 24 | chr4: 186232192-186232214 | AUCUGGCAGUAUUGGGCAUU | G012276 | CR005992 | G013915 | 355 |
| 25 | chr4: 186236893-186236915 | GCGUGGCAUAUGAAAAAAAC | G012277 | CR005994 | NA | NA |
| 26 | chr4: 186236798-186236820 | UAUAAAGGAGUUGAUAUGAG | G012278 | CR005995 | G013913 | 353 |
| 27 | chr4: 186236938-186236960 | ACACCUUGAAUUGUACUCAC | G012279 | CR005998 | NA | NA |
| 28 | chr4: 186232214-186232236 | UGAGGUGCACAUUCCACCCA | G012280 | NA | NA | NA |
| 29 | chr4: 186232190-186232212 | CUGGCAGUAUUGGGCAUUUG | G012281 | NA | NA | NA |
| 30 | chr4: 186232148-186232170 | AAAACGCCUUCUUCAGAGGU | G012282 | NA | NA | NA |
| 31 | chr4: 186232227-186232249 | UGAAUAGCAAACACCUUGGG | G012283 | NA | NA | NA |
| 32 | chr4: 186236821-186236843 | AGUCAAUUUUAAUGUGUCUA | G012284 | NA | NA | NA |
| 33 | chr4: 186236850-186236872 | GUGUUGAAGAAUGCCAAAAA | G012285 | NA | NA | NA |

TABLE 1-continued

Human KLKB1 targeted guide sequence, chromosomal coordinates, and human single guide RNAs and dual guide RNAs, and surrogate cynomolgus (cyno) monkey single guides

| SEQ ID NO: (human) | Exemplary Genomic Coordinates (hg38) | human guide sequence | human sgRNA | human dgRNA | cyno sgRNA | Cyno guide SEQ ID NO: |
|---|---|---|---|---|---|---|
| 34 | chr4: 186236910-186236932 | UGCCUUGUGAAAUGUUUGCG | G012286 | NA | NA | NA |
| 35 | chr4: 186250265-186250287 | GCAUCUUGCGUUCUCAGAUG | G012287 | NA | G013927 | 367 |
| 36 | chr4: 186250276-186250298 | UCUCAGAUGUGGAUGUUGCC | G012288 | NA | NA | NA |
| 37 | chr4: 186250306-186250328 | CUCCAGAUGCUUUUGUGUGU | G012289 | NA | NA | NA |
| 38 | chr4: 186251325-186251347 | UAUUAUCAAAUCACAUUACC | G012290 | NA | NA | NA |
| 39 | chr4: 186251271-186251293 | CCAGAUAUGGUGUUUUCUUG | G012291 | NA | NA | NA |
| 40 | chr4: 186251300-186251322 | AAGUUCUUUUGCAGGUUAAA | G012292 | NA | NA | NA |
| 41 | chr4: 186251620-186251642 | UUUACUCCCAGAAGACUGUA | G012293 | NA | NA | NA |
| 42 | chr4: 186251492-186251514 | UGCCAUUCUAAAAUUUACCC | G012294 | NA | NA | NA |
| 43 | chr4: 186251572-186251594 | UCAUCUUUGUGCAAGUCUCU | G012295 | NA | NA | NA |
| 44 | chr4: 186251510-186251532 | UCUCCUCCAAAGUCAACUCC | G012296 | NA | NA | NA |
| 45 | chr4: 186252049-186252071 | GGAGGAACAAACUCUUCUUG | G012297 | NA | NA | NA |
| 46 | chr4: 186252098-186252120 | AGGUGAAGCUGACAGCUCAG | G012298 | NA | NA | NA |
| 47 | chr4: 186256046-186256068 | CCAUCCGGUUACCCAACAGU | G012299 | NA | G013931 | 371 |
| 48 | chr4: 186256042-186256064 | UAUACCAACUGUUGGGUAAC | G012300 | NA | G012300 | NA |
| 49 | chr4: 186256034-186256056 | GCACAAUUUAUACCAACUGU | G012301 | NA | NA | NA |
| 50 | chr4: 186256059-186256081 | AACCGGAUGGGGCUUCUCGA | G012302 | NA | G013932 | 372 |
| 51 | chr4: 186256047-186256069 | CAACUGUUGGGUAACCGGAU | G012303 | NA | G013882 | 322 |
| 52 | chr4: 186256035-186256057 | CACAAUUUAUACCAACUGUU | G012304 | NA | G012304 | NA |
| 53 | chr4: 186256046-186256068 | CCAACUGUUGGGUAACCGGA | G012305 | NA | G013924 | 364 |
| 54 | chr4: 186256061-186256083 | CUCCUUCGAGAAGCCCCAUC | G012306 | NA | NA | NA |
| 55 | chr4: 186256048-186256070 | AACUGUUGGGUAACCGGAUG | G012307 | NA | G013914 | 354 |
| 56 | chr4: 186256003-186256025 | CCAAUAUGCCUACCUUCCAA | G012308 | NA | NA | NA |
| 57 | chr4: 186256015-186256037 | GUGCUUGUGUCACCUUUGGA | G012309 | NA | G013900 | 340 |
| 58 | chr4: 186256011-186256033 | UUGUGUCACCUUUGGAAGGU | G012310 | NA | NA | NA |
| 59 | chr4: 186256019-186256041 | AAUUGUGCUUGUGUCACCUU | G012311 | NA | NA | NA |
| 60 | chr4: 186255996-186256018 | AAGGUAGGCAUAUUGGUUUU | G012312 | NA | NA | NA |
| 61 | chr4: 186257312-186257334 | ACCCAACGGAUGGUCUGUGC | G012313 | NA | NA | NA |
| 62 | chr4: 186257314-186257336 | AGCCAGCACAGACCAUCCGU | G012314 | NA | NA | NA |
| 63 | chr4: 186257302-186257324 | UUAUAAAAUAACCCAACGGA | G012315 | NA | G012315 | NA |
| 64 | chr4: 186257326-186257348 | CUGUGCUGGCUAUAAAGAAG | G012316 | NA | NA | NA |
| 65 | chr4: 186257261-186257283 | CAUUCUUCAUUUGUUACCAA | G012317 | NA | NA | NA |
| 66 | chr4: 186257284-186257306 | UAUAAUCUUGAUAUCUUUUC | G012318 | NA | NA | NA |
| 67 | chr4: 186257313-186257335 | GCCAGCACAGACCAUCCGUU | G012319 | NA | NA | NA |
| 68 | chr4: 186257324-186257346 | GUCUGUGCUGGCUAUAAAGA | G012320 | NA | G012320 | NA |

TABLE 1-continued

Human KLKB1 targeted guide sequence, chromosomal coordinates, and human single guide RNAs and dual guide RNAs, and surrogate cynomolgus (cyno) monkey single guides

| SEQ ID NO: (human) | Exemplary Genomic Coordinates (hg38) | human guide sequence | human sgRNA | human dgRNA | cyno sgRNA | Cyno guide SEQ ID NO: |
|---|---|---|---|---|---|---|
| 69 | chr4: 186257325-186257347 | UCUGUGCUGGCUAUAAAGAA | G012321 | NA | NA | NA |
| 70 | chr4: 186258130-186258152 | GUCCAUGUACUCAGCGACUU | G012322 | NA | G012322 | NA |
| 71 | chr4: 186258128-186258150 | CACCAAAGUCGCUGAGUACA | G012323 | NA | G012323 | NA |
| 72 | chr4: 186258050-186258072 | ACACAAUGGAAUGUGGCGUU | G012324 | NA | G012324 | NA |
| 73 | chr4: 186258068-186258090 | UUUGGUGGGCAUCACCAGCU | G012325 | NA | G012325 | NA |
| 74 | chr4: 186258204-186258226 | CUCUGGACUGCUUCUCAUGC | G012326 | NA | NA | NA |
| 75 | chr4: 186258133-186258155 | AAGUCGCUGAGUACAUGGAC | G012327 | NA | G012327 | NA |
| 76 | chr4: 186258089-186258111 | GGGUGAAGGCUGUGCCCGCA | G012328 | NA | G013895 | 335 |
| 77 | chr4: 186258054-186258076 | AAUGGAAUGUGGCGUUUGGU | G012329 | NA | G012329 | NA |
| 78 | chr4: 186258037-186258059 | UCCAUUGUGUUUGCAAACUA | G012330 | NA | G013942 | 382 |
| 79 | chr4: 186258067-186258089 | GUUUGGUGGGCAUCACCAGC | G012331 | NA | NA | NA |
| 80 | chr4: 186258043-186258065 | UUUGCAAACACAAUGGAAUG | G012332 | NA | G013916 | 356 |
| 81 | chr4: 186258103-186258125 | GACACCAGGUUGCUCCCUGC | G012333 | NA | NA | NA |
| 82 | chr4: 186258009-186258031 | ACUGUGACUCAGGGAGAUUC | G012334 | NA | G013943 | 383 |
| 83 | chr4: 186258099-186258121 | UGUGCCCGCAGGGAGCAACC | G012335 | NA | NA | NA |
| 84 | chr4: 186258036-186258058 | CCAUUGUGUUUGCAAACUAA | G012336 | NA | G013929 | 369 |
| 85 | chr4: 186258088-186258110 | GGGGUGAAGGCUGUGCCCGC | G012337 | NA | NA | NA |
| 86 | chr4: 186258117-186258139 | GCGACUUUGGUGUAGACACC | G012338 | NA | NA | NA |
| 87 | chr4: 186258036-186258058 | CCCUUAGUUUGCAAACACAA | G012339 | NA | NA | NA |
| 88 | chr4: 186258053-186258075 | CAAUGGAAUGUGGCGUUUGG | G012340 | NA | G012340 | NA |
| 89 | chr4: 186232230-186232252 | AACUGAAUAGCAAACACCUU | NA | CR005919 | NA | NA |
| 90 | chr4: 186238351-186238373 | ACAAUUACCAAUUUCUGAAA | NA | CR005920 | NA | NA |
| 91 | chr4: 186238352-186238374 | UACAAUUACCAAUUUCUGAA | NA | CR005921 | NA | NA |
| 92 | chr4: 186251263-186251285 | GGUGUUUUCUUGAGGAGUAG | NA | CR005923 | NA | NA |
| 93 | chr4: 186251490-186251512 | CGGGUAAAUUUUAGAAUGGC | NA | CR005926 | G013884 | 324 |
| 94 | chr4: 186251494-186251516 | CUCCCGGGUAAAUUUUAGAA | NA | CR005927 | G013925 | 365 |
| 95 | chr4: 186251801-186251823 | UAUGGGACACAAGGGAGCUC | NA | CR005930 | NA | NA |
| 96 | chr4: 186252047-186252069 | UUGGAGGAACAAACUCUUCU | NA | CR005934 | G013912 | 352 |
| 97 | chr4: 186252048-186252070 | UGGAGGAACAAACUCUUCUU | NA | CR005935 | NA | NA |
| 98 | chr4: 186252056-186252078 | CAAACUCUUCUUGGGGAGAG | NA | CR005936 | NA | NA |
| 99 | chr4: 186252123-186252145 | CUAUGAGUGACCCUCCACAC | NA | CR005937 | G013886 | 326 |
| 100 | chr4: 186252124-186252146 | CUGUGUGGAGGGUCACUCAU | NA | CR005938 | G013938 | 378 |
| 101 | chr4: 186252134-186252156 | GGUCACUCAUAGGACACCAG | NA | CR005939 | G013946 | 386 |
| 102 | chr4: 186252135-186252157 | GUCACUCAUAGGACACCAGU | NA | CR005940 | G013896 | 336 |
| 103 | chr4: 186252163-186252185 | ACUGCUGCCCACUGCUUUGA | NA | CR005941 | NA | NA |
| 104 | chr4: 186252171-186252193 | ACACUUACCCAUCAAAGCAG | NA | CR005942 | G013902 | 342 |

TABLE 1-continued

Human KLKB1 targeted guide sequence, chromosomal coordinates, and human single guide RNAs and dual guide RNAs, and surrogate cynomolgus (cyno) monkey single guides

| SEQ ID NO: (human) | Exemplary Genomic Coordinates (hg38) | human guide sequence | human sgRNA | human dgRNA | cyno sgRNA | Cyno guide SEQ ID NO: |
|---|---|---|---|---|---|---|
| 105 | chr4: 186238286-186238308 | AGGAACACCUACCGCUAUAA | NA | CR005944 | G013871 | 311 |
| 106 | chr4: 186238265-186238287 | CUCCGGGACUGUACUUUAAU | NA | CR005945 | G013889 | 329 |
| 107 | chr4: 186251786-186251808 | GUCCCAUACGCAAUCCUAGU | NA | CR005946 | G013890 | 330 |
| 108 | chr4: 186238293-186238315 | CUCAGCACCUUUAUAGCGGU | NA | CR005947 | G013892 | 332 |
| 109 | chr4: 186238282-186238304 | UAUAGCGGUAGGUGUUCCUC | NA | CR005948 | G013874 | 314 |
| 110 | chr4: 186238266-186238288 | CUAUUAAAGUACAGUCCCGG | NA | CR005950 | G013875 | 315 |
| 111 | chr4: 186238308-186238330 | GUGCUGAGUAACGUGGAAUC | NA | CR005953 | G013883 | 323 |
| 112 | chr4: 186238301-186238323 | UAUAAAGGUGCUGAGUAACG | NA | CR005954 | G013878 | 318 |
| 113 | chr4: 186251783-186251805 | UCUCCAACUAGGAUUGCGUA | NA | CR005955 | G013908 | 348 |
| 114 | chr4: 186238281-186238303 | AUAGCGGUAGGUGUUCCUCC | NA | CR005957 | G013873 | 313 |
| 115 | chr4: 186233989-186234011 | CUGCCAAAAGUACAUCGAAC | NA | CR005958 | G013877 | 317 |
| 116 | chr4: 186238345-186238367 | ACCAAUUUCUGAAAGGGCAC | NA | CR005961 | NA | NA |
| 117 | chr4: 186251755-186251777 | GUGUUUCUUAAGAUUAUCUA | NA | CR005962 | NA | NA |
| 118 | chr4: 186238344-186238366 | CCAAUUUCUGAAAGGGCACA | NA | CR005964 | NA | NA |
| 119 | chr4: 186251759-186251781 | UUCUUAAGAUUAUCUAUGGA | NA | CR005965 | G013940 | 380 |
| 120 | chr4: 186233988-186234010 | CUGUUCGAUGUACUUUUGGC | NA | CR005966 | NA | NA |
| 121 | chr4: 186233987-186234009 | UGUUCGAUGUACUUUUGGCA | NA | CR005967 | G013880 | 320 |
| 122 | chr4: 186232209-186232231 | GGUGGAAUGUGCACCUCAUC | NA | CR005968 | G013939 | 379 |
| 123 | chr4: 186250308-186250330 | GUCCGACACACAAAAGCAUC | NA | CR005969 | G013894 | 334 |
| 124 | chr4: 186236877-186236899 | AAACUGGCAGCGAAUGUUAC | NA | CR005971 | G013930 | 370 |
| 125 | chr4: 186236908-186236930 | UGCCACGCAAACAUUUCACA | NA | CR005972 | NA | NA |
| 126 | chr4: 186233992-186234014 | GCACCUGUUCGAUGUACUUU | NA | CR005973 | G013870 | 310 |
| 127 | chr4: 186254594-186254616 | AGAUGCGCCAAACAUCCUGC | NA | CR005974 | NA | NA |
| 128 | chr4: 186232199-186232221 | GCACCUCAUCUGGCAGUAUU | NA | CR005975 | NA | NA |
| 129 | chr4: 186250262-186250284 | CAUCUGAGAACGCAAGAUGC | NA | CR005976 | G013934 | 374 |
| 130 | chr4: 186232196-186232218 | AUGCCCAAUACUGCCAGAUG | NA | CR005977 | NA | NA |
| 131 | chr4: 186232200-186232222 | UGCACCUCAUCUGGCAGUAU | NA | CR005978 | G013944 | 384 |
| 132 | chr4: 186232258-186232280 | AUGUCAUUGAUUGAACUUGC | NA | CR005980 | G013936 | 376 |
| 133 | chr4: 186252031-186252053 | ACAAGCACACGCAUUGUUGG | NA | CR005981 | G013893 | 333 |
| 134 | chr4: 186254723-186254745 | UAUCGCCUUGAUAAAACUCC | NA | CR005984 | G013926 | 366 |
| 135 | chr4: 186251271-186251293 | CCUCAAGAAAACACCAUAUC | NA | CR005985 | G013906 | 346 |
| 136 | chr4: 186232149-186232171 | AAACGCCUUCUUCAGAGGUG | NA | CR005986 | NA | NA |
| 137 | chr4: 186252028-186252050 | AAAACAAGCACACGCAUUGU | NA | CR005987 | G013891 | 331 |
| 138 | chr4: 186234001-186234023 | CAUCGAACAGGUGCAGUUUC | NA | CR005988 | G013879 | 319 |
| 139 | chr4: 186254587-186254609 | GGCUUCCCCUGCAGGAUGUU | NA | CR005989 | G013881 | 321 |

TABLE 1-continued

Human KLKB1 targeted guide sequence, chromosomal coordinates, and human single guide RNAs and dual guide RNAs, and surrogate cynomolgus (cyno) monkey single guides

| SEQ ID NO: (human) | Exemplary Genomic Coordinates (hg38) | human guide sequence | human sgRNA | human dgRNA | cyno sgRNA | Cyno guide SEQ ID NO: |
|---|---|---|---|---|---|---|
| 140 | chr4: 186234029-186234051 | UUGAUGACCACAUUGCUUCA | NA | CR005990 | G013937 | 377 |
| 141 | chr4: 186254728-186254750 | AGGAGCCUGGAGUUUUAUCA | NA | CR005991 | NA | NA |
| 142 | chr4: 186236783-186236805 | UGCCAUCGAGACAUUUAUAA | NA | CR005993 | G013899 | 339 |
| 143 | chr4: 186232260-186232282 | AGCAAGUUCAAUCAAUGACA | NA | CR005996 | G013897 | 337 |
| 144 | chr4: 186234022-186234044 | GGACAUUCCUUGAAGCAAUG | NA | CR005997 | NA | NA |
| 145 | chr4: 186250330-186250352 | GUUGGGGUGAUAGGUGCAGA | NA | CR005999 | NA | NA |
| 146 | chr4: 186232147-186232169 | GAAAACGCCUUCUUCAGAGG | NA | CR006000 | NA | NA |
| 147 | chr4: 186232144-186232166 | UAUGAAAACGCCUUCUUCAG | NA | CR006001 | NA | NA |
| 148 | chr4: 186250277-186250299 | CUCAGAUGUGGAUGUUGCCA | NA | CR006002 | NA | NA |
| 149 | chr4: 186254579-186254601 | CUCUCCUAGGCUUCCCCUGC | NA | CR006003 | NA | NA |

TABLE 2

Cyno KLKB1 targeted single guide sequences, chromosomal coordinates, and guide sequence homology to human

| Cyno sgRNA | Cyno SEQ ID NO | Exemplary Genomic Coordinates (mf5) | cyno guide sequence | Percent homology to human guide |
|---|---|---|---|---|
| G013870 | 310 | chr5: 185648888-185648908 | GCACCUGCUCGACGUACUUU | 90 |
| G013871 | 311 | chr5: 185652966-185652986 | AGGAACGCCUACCACUAUAA | 90 |
| G013872 | 312 | chr5: 185688465-185688485 | UGAUGGAAACGCUCGGAUGC | NA |
| G013873 | 313 | chr5: 185652964-185652984 | AUAGUGGUAGGCGUUCCUCC | 90 |
| G013874 | 314 | chr5: 185652965-185652985 | UAUAGUGGUAGGCGUUCCUC | 90 |
| G013875 | 315 | chr5: 185652946-185652966 | CUCUUAAAGCACAGUCCCGG | 90 |
| G013876 | 316 | chr5: 185684512-185684532 | AAUGCGCCAAACAUCCGGUA | 100 |
| G013877 | 317 | chr5: 185648882-185648902 | UUGCCAAAAGUACGUCGAGC | 85 |
| G013878 | 318 | chr5: 185652981-185653001 | UAUAAAGGUGCUGAAUAACG | 95 |
| G013879 | 319 | chr5: 185648894-185648914 | CGUCGAGCAGGUGCAAUUUC | 85 |
| G013880 | 320 | chr5: 185648883-185648903 | UGCUCGACGUACUUUUGGCA | 90 |
| G013881 | 321 | chr5: 185684503-185684523 | GGCUUCCCUUACCGGAUGUU | 85 |
| G013882 | 322 | chr4: 186256046-186256066 | CAACUGUUGGGUAACUGGAU | 100 |
| G013883 | 323 | chr5: 185652988-185653008 | GUGCUGAAUAACGUGGAAUC | 95 |
| G013884 | 324 | chr5: 185680852-185680872 | CGGGUAAAUUUUAGAAUGGC | 100 |
| G013885 | 325 | chr5: 185684511-185684531 | AUGCGCCAAACAUCCGGUAA | 100 |
| G013886 | 326 | chr5: 185681472-185681492 | CUAUGAGUGACCCUCCACAC | 100 |
| G013887 | 327 | chr5: 185679339-185679359 | GGCAACAUCCACAUCCGAGA | NA |
| G013888 | 328 | chr5: 185679426-185679446 | UUACGUUCUAUACGAAUGCA | 85 |
| G013889 | 329 | chr5: 185652948-185652968 | CUCCGGGACUGUGCUUUAAG | 90 |

TABLE 2-continued

Cyno KLKB1 targeted single guide sequences, chromosomal coordinates, and guide sequence homology to human

| Cyno sgRNA | Cyno SEQ ID NO | Exemplary Genomic Coordinates (mf5) | cyno guide sequence | Percent homology to human guide |
|---|---|---|---|---|
| G013890 | 330 | chr5: 185681135-185681155 | GUCCCAUAUGUAAUCCUAGU | 90 |
| G013891 | 331 | chr5: 185681374-185681394 | AAAACAAGCUCACGCAUUGU | 95 |
| G013892 | 332 | chr5: 185652976-185652996 | UUCAGCACCUUUAUAGUGGU | 90 |
| G013893 | 333 | chr5: 185681377-185681397 | ACAAGCUCACGCAUUGUUGG | 95 |
| G013894 | 334 | chr5: 185679374-185679394 | GUUCGACACACAAAAGCAUC | 95 |
| G013895 | 335 | chr4: 186258088-186258108 | GGGCGAAGGCUGUGCCCGCA | 100 |
| G013896 | 336 | chr5: 185681481-185681501 | GUCACUCAUAGGACACCAGU | 100 |
| G013897 | 337 | chr5: 185647160-185647180 | AGCAAGUUCCAUCAAUGACA | 95 |
| G013898 | 338 | chr5: 185679413-185679433 | AACGUAAAGAAGAGGCAGCU | 100 |
| G013899 | 339 | chr5: 185651465-185651485 | UGCCACCGAGACAUUUAUAA | 95 |
| G013900 | 340 | chr4: 186256017-186256037 | GUGUUUGUGUCACCUUUGGA | 100 |
| G013901 | 341 | chr4: 186251792-186251812 | GGAUUACAUAUGGGACACAA | 100 |
| G013902 | 342 | chr5: 185681520-185681540 | ACACUUACCCAUCAAAGCAG | 100 |
| G013903 | 343 | chr5: 185684660-185684680 | CAGUGUAAUUCAAAGGAGCC | 100 |
| G013904 | 344 | chr5: 185681138-185681158 | AGGAUUACAUAUGGGACACA | 100 |
| G013905 | 345 | chr5: 185651470-185651490 | UUCCUUUAUAAAUGUCUCGG | 100 |
| G013906 | 346 | chr5: 185680632-185680652 | CCUCAAGAAAACACCACAUC | 95 |
| G013907 | 347 | chr5: 185688458-185688478 | AGAGCAGUGAUGGAAACGCU | NA |
| G013908 | 348 | chr5: 185681129-185681149 | UCUCCAACUAGGAUUACAUA | 90 |
| G013909 | 349 | chr5: 185680982-185681002 | ACUCCCAGAAGACUGUAAGG | NA |
| G013910 | 350 | chr5: 185679360-185679380 | AGCAUCUGGGGCGAGAACUC | 100 |
| G013911 | 351 | chr5: 185679372-185679392 | UCGACACACAAAAGCAUCUG | NA |
| G013912 | 352 | chr5: 185681393-185681413 | UUGGAGGAACAAACUCUUCU | 100 |
| G013913 | 353 | chr4: 186236797-186236817 | UAUAAAGGAAUUGAUAUGAG | 100 |
| G013914 | 354 | chr4: 186256047-186256067 | AACUGUUGGGUAACUGGAUG | 100 |
| G013915 | 355 | chr5: 185647095-185647115 | AUCUGGCAGUGCUGGGCGUU | 100 |
| G013916 | 356 | chr4: 186258042-186258062 | CUUGCAAACACAAUGGAAUG | 100 |
| G013917 | 357 | chr4: 186251628-186251648 | UCUCCUCCUUACAGUCUUCU | |
| G013918 | 358 | chr5: 185688296-185688316 | CUGUGACUCAGGGAGAUUCA | NA |
| G013918 | 358 | chr5: 185688296-185688316 | CUGUGACUCAGGGAGAUUCA | 100 |
| G013919 | 359 | chr4: 186258084-186258104 | GGCACAGCCUUCGCCCCAGC | 100 |
| G013920 | 360 | chr5: 185647084-185647104 | CUGGGCGUUCGGGGUGUACA | 100 |
| G013921 | 361 | chr4: 186254600-186254620 | GAUGUUUGGCGCAUUUAUAG | 100 |
| G013922 | 362 | chr4: 186251771-186251791 | CUUCGGAUGGUUCUCCAACU | |
| G013923 | 363 | chr5: 185684517-185684537 | CUAUAAAUGCGCCAAACAUC | NA |
| G013923 | 363 | chr5: 185684517-185684537 | CUAUAAAUGCGCCAAACAUC | 100 |

TABLE 2-continued

Cyno KLKB1 targeted single guide sequences, chromosomal coordinates, and guide sequence homology to human

| Cyno sgRNA | Cyno SEQ ID NO | Exemplary Genomic Coordinates (mf5) | cyno guide sequence | Percent homology to human guide |
|---|---|---|---|---|
| G013924 | 364 | chr4: 186256045-186256065 | CCAACUGUUGGGUAACUGGA | |
| G013925 | 365 | chr5: 185680856-185680876 | CUCCCGGGUAAAUUUUAGAA | 100 |
| G013926 | 366 | chr5: 185684639-185684659 | UAUCGCCUUAAUAAAACUCC | 95 |
| G013926 | 366 | chr4: 186254722-186254742 | UAUCGCCUUAAUAAAACUCC | 100 |
| G013927 | 367 | chr4: 186250264-186250284 | GCAUCUUGCCUUCUCGGAUG | |
| G013928 | 368 | chr5: 185679421-185679441 | UCGUAUAGAACGUAAAGAAG | 90 |
| G013929 | 369 | chr4: 186258038-186258058 | CCAUUGUGUUUGCAAGCUAA | 100 |
| G013930 | 370 | chr5: 185651562-185651582 | AAAUUGGCAGCGAAUGUUAU | 90 |
| G013930 | 370 | chr4: 186236879-186236899 | AAAUUGGCAGCGAAUGUUAU | 100 |
| G013931 | 371 | chr4: 186256048-186256068 | CCAUCCAGUUACCCAACAGU | 100 |
| G013932 | 372 | chr4: 186256058-186256078 | AACUGGAUGGGGCUUCUCGA | 100 |
| G013933 | 373 | chr5: 185681130-185681150 | CUCCAACUAGGAUUACAUAU | 100 |
| G013934 | 374 | chr5: 185679328-185679348 | CAUCCGAGAAGGCAAGAUGC | 90 |
| G013935 | 375 | chr4: 186251536-186251556 | UUGAAUGUGACUUUCGUUAA | 100 |
| G013936 | 376 | chr5: 185647161-185647181 | AUGUCAUUGAUGGAACUUGC | 95 |
| G013937 | 377 | chr5: 185648925-185648945 | UUGAUGACCACACUGCUUUA | 90 |
| G013938 | 378 | chr5: 185681470-185681490 | CUGUGUGGAGGGUCACUCAU | 100 |
| G013939 | 379 | chr5: 185647112-185647132 | GGUGGAAUGUGCACAUCAUC | 95 |
| G013940 | 380 | chr5: 185681105-185681125 | UUCUUAAGAUUAUCUUCGGA | 90 |
| G013941 | 381 | chr5: 185685921-185685941 | CCUUUGGAAGGUAGGCAUAU | 100 |
| G013942 | 382 | chr4: 186258039-186258059 | UCCAUUGUGUUUGCAAGCUA | 100 |
| G013943 | 383 | chr4: 186258008-186258028 | CCUGUGACUCAGGGAGAUUC | 100 |
| G013944 | 384 | chr5: 185647103-185647123 | UGCACAUCAUCUGGCAGUGC | 85 |
| G013945 | 385 | chr4: 186238299-186238319 | GUUAUUCAGCACCUUUAUAG | 100 |
| G013946 | 386 | chr5: 185681480-185681500 | GGUCACUCAUAGGACACCAG | 100 |

The guide RNAs identified above as "G0XXXXX" are sgRNAs comprising the identified 20 nucleotide targeting sequence of Table 1 or Table 2, within the guide structure of SEQ ID NO: 300. In some embodiments, the sgRNA comprises any one of the guide RNAs of Tables 1 or 2 and the nucleotides of SEQ ID NO: 300, optionally wherein the sgRNA comprises any one of the modification patterns described in Table 4. In some embodiments, the sgRNA comprises any one of the guide RNAs of Tables 1 or 2 and any of the conserved portion of sgRNAs of Table 4, optionally with any one of the modification patterns described in Table 4.

TABLE 3A (Conserved Portion of a spyCas9 sgRNA; SEQ ID NO: 500)

| 1 | 2 | 3 | 4 | 5 | 6 | 7 | 8 | 9 | 10 | 11 | 12 | 13 |
|---|---|---|---|---|---|---|---|---|---|---|---|---|
| G | U | U | U | U | A | G | A | G | C | U | A | G |

TABLE 3A-continued (Conserved Portion of a spyCas9 sgRNA; SEQ ID NO: 500)

| LS1-LS6 | | | | | | B1-B2 | | | | US1-US12 | | |
|---|---|---|---|---|---|---|---|---|---|---|---|---|
| 14 | 15 | 16 | 17 | 18 | 19 | 20 | 21 | 22 | 23 | 24 | 25 | 26 |
| A | A | A | U | A | G | C | A | A | G | U | U | A |
| | | US1-US12 | | | | | | B2-B6 | | | LS7-LS12 | |
| 27 | 28 | 29 | 30 | 31 | 32 | 33 | 34 | 35 | 36 | 37 | 38 | 39 |
| A | A | A | U | A | A | G | G | C | U | A | G | U |
| | LS7-LS12 | | | | | | | Nexus | | | | |
| 40 | 41 | 42 | 43 | 44 | 45 | 46 | 47 | 48 | 49 | 50 | 51 | 52 |
| C | C | G | U | U | A | U | C | A | A | C | U | U |
| | | | | Nexus | | | | | | H1-1 through H1-12 | | |

TABLE 3A-continued

| (Conserved Portion of a spyCas9 sgRNA; SEQ ID NO: 500) | | | | | | | | | | | | |
|---|---|---|---|---|---|---|---|---|---|---|---|---|
| 53 | 54 | 55 | 56 | 57 | 58 | 59 | 60 | 61 | 62 | 63 | 64 | 65 |
| G | A | A | A | A | A | G | U | G | G | C | A | C |
| H1-1 through H1-12 | | | | | | | | N | H2-1 through H2-15 | | | |

| | | | | | | | | | | |
|---|---|---|---|---|---|---|---|---|---|---|
| 66 | 67 | 68 | 69 | 70 | 71 | 72 | 73 | 74 | 75 | 76 |
| C | G | A | G | U | C | G | G | U | G | C |
| H2-1 through H2-15 | | | | | | | | | | |

TABLE 3B

| 5' terminus (n) | LS1-6 lower stem | n | B1-2 bulge | n | US1-12 upper stem |
|---|---|---|---|---|---|
| n | B3-6 bulge | n | LS7-12 lower stem | n | N1-18 nexus |
| n | H1-1 thru H1-12 hairpin 1 | n | H2-1 thru H2-15 hairpin 2 | 3' terminus | |

In some embodiments, the invention provides a composition comprising one or more guide RNAs (gRNA) comprising guide sequences that direct an RNA-guided DNA binding agent, which can be a nuclease (e.g., a Cas nuclease such as Cas9), to a target DNA sequence in KLKB1. The gRNA may comprise a crRNA comprising a guide sequence shown in Table 1. The gRNA may comprise a crRNA comprising 17, 18, 19, or 20 contiguous nucleotides of a guide sequence shown in Table 1. In some embodiments, the gRNA comprises a crRNA comprising a sequence with about 75%, 80%, 85%, 90%, 95%, 96%, 97%, 98%, 99%, or 100% identity to at least 17, 18, 19, or 20 contiguous nucleotides of a guide sequence shown in Table 1. In some embodiments, the gRNA comprises a crRNA comprising a sequence with about 75%, 80%, 85%, 90%, 95%, 96%, 97%, 98%, 99%, or 100% identity to a guide sequence shown in Table 1. The gRNA may further comprise a trRNA. In each composition and method embodiment described herein, the crRNA and trRNA may be associated as a single RNA (sgRNA) or may be on separate RNAs (dgRNA). In the context of sgRNAs, the crRNA and trRNA components may be covalently linked, e.g., via a phosphodiester bond or other covalent bond.

In each of the compositions, use, and method embodiments described herein, the guide RNA may comprise two RNA molecules as a "dual guide RNA" or "dgRNA." The dgRNA comprises a first RNA molecule comprising a crRNA comprising, e.g., a guide sequence shown in Table 1, and a second RNA molecule comprising a trRNA. The first and second RNA molecules may not be covalently linked, but may form an RNA duplex via the base pairing between portions of the crRNA and the trRNA.

In each of the composition, use, and method embodiments described herein, the guide RNA may comprise a single RNA molecule as a "single guide RNA" or "sgRNA". The sgRNA may comprise a crRNA (or a portion thereof) comprising a guide sequence shown in Table 1 covalently linked to a trRNA. The sgRNA may comprise 17, 18, 19, or 20 contiguous nucleotides of a guide sequence shown in Table 1. In some embodiments, the crRNA and the trRNA are covalently linked via a linker. In some embodiments, the sgRNA forms a stem-loop structure via the base pairing between portions of the crRNA and the trRNA. In some embodiments, the crRNA and the trRNA are covalently linked via one or more bonds that are not a phosphodiester bond.

In some embodiments, the trRNA may comprise all or a portion of a trRNA sequence derived from a naturally-occurring CRISPR/Cas system. In some embodiments, the trRNA comprises a truncated or modified wild type trRNA. The length of the trRNA depends on the CRISPR/Cas system used. In some embodiments, the trRNA comprises or consists of 5, 6, 7, 8, 9, 10, 11, 12, 13, 14, 15, 16, 17, 18, 19, 20, 25, 30, 40, 50, 60, 70, 80, 90, 100, or more than 100 nucleotides. In some embodiments, the trRNA may comprise certain secondary structures, such as, for example, one or more hairpin or stem-loop structures, or one or more bulge structures.

In some embodiments, a composition comprising one or more guide RNAs comprising a guide sequence of any one of SEQ ID NOs: 1-149 is provided. In some embodiments, a composition comprising one or more guide RNAs comprising a guide sequence of any one of SEQ ID Nos: 1-149 and any conserved portion of an sgRNA shown in Table 4, optionally having a modification pattern of any of an sgRNA shown in Table 4, optionally wherein the sgRNA comprises a 5' and 3' end modification (if not already shown in the construct of Table 4) is provided. In some embodiments, a composition comprising one or more guide RNAs comprising a guide sequence of any one of SEQ ID Nos: 1-149 is provided, wherein the nucleotides of SEQ ID NO: 170, 171, 172, or 173 follow the guide sequence at its 3' end. In some embodiments, the one or more guide RNAs comprising a guide sequence of any one of SEQ ID Nos: 1-149, wherein the nucleotides of SEQ ID NO: 170, 171, 172, or 173 follow the guide sequence at its 3' end, is modified according to the modification pattern of SEQ ID NO: 300.

In some embodiments, a composition comprising one or more guide RNAs comprising a guide sequence of any one of SEQ ID NOs: 1-149 is provided. In one aspect, a composition comprising one or more gRNAs is provided, comprising a guide sequence that is at least 99%, 98%, 97%, 96%, 95%, 94%, 93%, 92%, 91%, or 90% identical to any of the nucleic acids of SEQ ID NOs: 1-149.

In other embodiments, a composition is provided that comprises at least one, e.g., at least two gRNA's comprising guide sequences selected from any two or more of the guide sequences of SEQ ID NOs: 1-149. In some embodiments, the composition comprises at least two gRNAs that each comprise a guide sequence at least 99%, 98%, 97%, 96%, 95%, 94%, 93%, 92%, 91%, or 90% identical to any of the nucleic acids of SEQ ID NOs: 1-149.

The guide RNA compositions of the present invention are designed to recognize (e.g., hybridize to) a target sequence in the KLKB1 gene. For example, the KLKB1 target sequence may be recognized and cleaved by a provided Cas cleavase comprising a guide RNA. In some embodiments, an RNA-guided DNA binding agent, such as a Cas cleavase, may be directed by a guide RNA to a target sequence of the KLKB1 gene, where the guide sequence of the guide RNA hybridizes with the target sequence and the RNA-guided DNA binding agent, such as a Cas cleavase, cleaves the target sequence.

In some embodiments, the selection of the one or more guide RNAs is determined based on target sequences within the KLKB1 gene. In some embodiments, the compositions comprising one or more guide sequences comprise a guide sequence that is complementary to the corresponding genomic region shown in Table 1 below, according to coordinates from human reference genome hg38. Guide sequences of further embodiments may be complementary to sequences in the close vicinity of a genomic coordinate listed in any of the Tables provided herein. For example, guide sequences of further embodiments may be complementary to sequences that comprise 15 consecutive nucleotides plus-or-minus 10 nucleotides of a genomic coordinate listed in any of the Tables disclosed herein.

Without being bound by any particular theory, mutations (e.g., frameshift mutations resulting from indels occurring as a result of a nuclease-mediated DSB) in certain regions of the gene may be less tolerable than mutations in other regions of the gene, thus the location of a DSB is an important factor in the amount or type of protein knockdown that may result. In some embodiments, a gRNA complementary or having complementarity to a target sequence within KLKB1 is used to direct the RNA-guided DNA binding agent to a particular location in the KLKB1 gene. In some embodiments, gRNAs are designed to have guide sequences that are complementary or have complementarity to target sequences in exon 1, exon 3, exon 4, exon 5, exon 6, exon 8, exon 9, exon 10, exon 11, exon 12, exon 13, exon 14, or exon 15 of KLKB1.

In some embodiments, the guide sequence is at least 99%, 98%, 97%, 96%, 95%, 94%, 93%, 92%, 91%, or 90% identical to a target sequence present in the human KLKB1 gene. In some embodiments, the target sequence may be complementary to the guide sequence of the guide RNA. In some embodiments, the degree of complementarity or identity between a guide sequence of a guide RNA and its corresponding target sequence may be at least 80%, 85%, 90%, 95%, 96%, 97%, 98%, 99%, or 100%. In some embodiments, the target sequence and the guide sequence of the gRNA may be 100% complementary or identical. In other embodiments, the target sequence and the guide sequence of the gRNA may contain at least one mismatch. For example, the target sequence and the guide sequence of the gRNA may contain 1, 2, 3, or 4 mismatches, where the total length of the guide sequence is 20. In some embodiments, the target sequence and the guide sequence of the gRNA may contain 1-4 mismatches where the guide sequence is 20 nucleotides.

In some embodiments, a composition or formulation disclosed herein comprises an mRNA comprising an open reading frame (ORF) encoding an RNA-guided DNA binding agent, such as a Cas nuclease as described herein. In some embodiments, an mRNA comprising an ORF encoding an RNA-guided DNA binding agent, such as a Cas nuclease, is provided, used, or administered.

B. Modified gRNAs and mRNAs

In some embodiments, the gRNA is chemically modified. A gRNA comprising one or more modified nucleosides or nucleotides is called a "modified" gRNA or "chemically modified" gRNA, to describe the presence of one or more non-naturally and/or naturally occurring components or configurations that are used instead of or in addition to the canonical A, G, C, and U residues. In some embodiments, a modified gRNA is synthesized with a non-canonical nucleoside or nucleotide, is here called "modified." Modified nucleosides and nucleotides can include one or more of: (i) alteration, e.g., replacement, of one or both of the non-linking phosphate oxygens and/or of one or more of the linking phosphate oxygens in the phosphodiester backbone linkage (an exemplary backbone modification); (ii) alteration, e.g., replacement, of a constituent of the ribose sugar, e.g., of the 2' hydroxyl on the ribose sugar (an exemplary sugar modification); (iii) wholesale replacement of the phosphate moiety with "dephospho" linkers (an exemplary backbone modification); (iv) modification or replacement of a naturally occurring nucleobase, including with a non-canonical nucleobase (an exemplary base modification); (v) replacement or modification of the ribose-phosphate backbone (an exemplary backbone modification); (vi) modification of the 3' end or 5' end of the oligonucleotide, e.g., removal, modification or replacement of a terminal phosphate group or conjugation of a moiety, cap or linker (such 3' or 5' cap modifications may comprise a sugar and/or backbone modification); and (vii) modification or replacement of the sugar (an exemplary sugar modification).

Chemical modifications such as those listed above can be combined to provide modified gRNAs and/or mRNAs comprising nucleosides and nucleotides (collectively "residues") that can have two, three, four, or more modifications. For example, a modified residue can have a modified sugar and a modified nucleobase. In some embodiments, every base of a gRNA is modified, e.g., all bases have a modified phosphate group, such as a phosphorothioate group. In certain embodiments, all, or substantially all, of the phosphate groups of an gRNA molecule are replaced with phosphorothioate groups. In some embodiments, modified gRNAs comprise at least one modified residue at or near the 5' end of the RNA. In some embodiments, modified gRNAs comprise at least one modified residue at or near the 3' end of the RNA.

In some embodiments, the gRNA comprises one, two, three or more modified residues. In some embodiments, at least 5% (e.g., at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or 100%) of the positions in a modified gRNA are modified nucleosides or nucleotides.

Unmodified nucleic acids can be prone to degradation by, e.g., intracellular nucleases or those found in serum. For example, nucleases can hydrolyze nucleic acid phosphodiester bonds. Accordingly, in one aspect the gRNAs described herein can contain one or more modified nucleosides or nucleotides, e.g., to introduce stability toward intracellular or serum-based nucleases. In some embodiments, the modified gRNA molecules described herein can exhibit a reduced innate immune response when introduced into a population of cells, both in vivo and ex vivo. The term "innate immune response" includes a cellular response to exogenous nucleic acids, including single stranded nucleic acids, which involves the induction of cytokine expression and release, particularly the interferons, and cell death.

In some embodiments of a backbone modification, the phosphate group of a modified residue can be modified by replacing one or more of the oxygens with a different substituent. Further, the modified residue, e.g., modified residue present in a modified nucleic acid, can include the wholesale replacement of an unmodified phosphate moiety with a modified phosphate group as described herein. In some embodiments, the backbone modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. The phosphorous atom in an unmodified phosphate group is achiral. However, replacement of one of the nonbridging oxygens with one of the above atoms or groups of atoms can render the phosphorous atom chiral. The stereogenic phosphorous atom can possess either the "R" configuration (herein Rp) or the "S" configuration (herein Sp). The backbone can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

The phosphate group can be replaced by non-phosphorus containing connectors in certain backbone modifications. In some embodiments, the charged phosphate group can be replaced by a neutral moiety. Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Scaffolds that can mimic nucleic acids can also be constructed wherein the phosphate linker and ribose sugar are replaced by nuclease resistant nucleoside or nucleotide surrogates. Such modifications may comprise backbone and sugar modifications. In some embodiments, the nucleobases can be tethered by a surrogate backbone. Examples can include, without limitation, the morpholino, cyclobutyl, pyrrolidine and peptide nucleic acid (PNA) nucleoside surrogates.

The modified nucleosides and modified nucleotides can include one or more modifications to the sugar group, i.e. a sugar modification. For example, the 2' hydroxyl group (OH) can be modified, e.g. replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion.

Examples of 2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the 2' hydroxyl group modification can be 2'-O-Me. In some embodiments, the 2' hydroxyl group modification can be a 2'-fluoro modification, which replaces the 2' hydroxyl group with a fluoride. In some embodiments, the 2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the 2' hydroxyl group modification can include "unlocked" nucleic acids (UNA) in which the ribose ring lacks the C2'-C3' bond. In some embodiments, the 2' hydroxyl group modification can include the methoxyethyl group (MOE), ($OCH_2CH_2OCH_3$, e.g., a PEG derivative).

"Deoxy" 2' modifications can include hydrogen (i.e. deoxyribose sugars, e.g., at the overhang portions of partially dsRNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH2CH_2$— amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar modification can comprise a sugar group which may also contain one or more carbons that possess the opposite stereochemical configuration than that of the corresponding carbon in ribose. Thus, a modified nucleic acid can include nucleotides containing e.g., arabinose, as the sugar. The modified nucleic acids can also include abasic sugars. These abasic sugars can also be further modified at one or more of the constituent sugar atoms. The modified nucleic acids can also include one or more sugars that are in the L form, e.g. L-nucleosides.

The modified nucleosides and modified nucleotides described herein, which can be incorporated into a modified nucleic acid, can include a modified base, also called a nucleobase. Examples of nucleobases include, but are not limited to, adenine (A), guanine (G), cytosine (C), and uracil (U). These nucleobases can be modified or wholly replaced to provide modified residues that can be incorporated into modified nucleic acids. The nucleobase of the nucleotide can be independently selected from a purine, a pyrimidine, a purine analog, or pyrimidine analog. In some embodiments, the nucleobase can include, for example, naturally occurring and synthetic derivatives of a base.

In embodiments employing a dual guide RNA, each of the crRNA and the tracr RNA can contain modifications. Such modifications may be at one or both ends of the crRNA and/or tracr RNA. In embodiments comprising an sgRNA, one or more residues at one or both ends of the sgRNA may be chemically modified, and/or internal nucleosides may be modified, and/or the entire sgRNA may be chemically modified. Certain embodiments comprise a 5' end modification. Certain embodiments comprise a 3' end modification.

In some embodiments, the guide RNAs disclosed herein comprise one of the modification patterns disclosed in WO2018/107028 and/or WO2019/237069, the contents of which are hereby incorporated by reference in their entirety. For example, the guide RNAs disclosed herein may comprise the short-guide structure described at claims 1-15 and/or the modification patterns described at claims 16-462 of WO2019/237069. In some embodiments, the guide RNAs disclosed herein comprise one of the structures/modification patterns disclosed in WO 2015/200555, the contents of which are hereby incorporated by reference in their entirety. In some embodiments, the guide RNAs disclosed herein comprise one of the structures/modification patterns disclosed in WO2017/136794, the contents of which are hereby incorporated by reference in their entirety.

C. YA Modifications

A modification at a YA site (also referred to herein as "YA modification") can be a modification of the internucleoside linkage, a modification of the base (pyrimidine or adenine), e.g. by chemical modification, substitution, or otherwise, and/or a modification of the sugar (e.g. at the 2' position, such as 2'-O-alkyl, 2'-F, 2'-moe, 2'-F arabinose, 2'-H (deoxyribose), and the like). In some embodiments, a "YA modification" is any modification that alters the structure of the dinucleotide motif to reduce RNA endonuclease activity, e.g., by interfering with recognition or cleavage of a YA site by an RNase and/or by stabilizing an RNA structure (e.g., secondary structure) that decreases accessibility of a cleavage site to an RNase. See Peacock et al., *J Org Chem.* 76: 7295-7300 (2011); Behlke, *Oligonucleotides* 18:305-320 (2008); Ku et al., *Adv. Drug Delivery Reviews* 104: 16-28 (2016); Ghidini et al., *Chem. Commun.,* 2013, 49, 9036. Peacock et al., Belhke, Ku, and Ghidini provide exemplary modifications suitable as YA modifications. Modifications known to those of skill in the art to reduce endonucleolytic degradation are encompassed. Exemplary 2' ribose modifications that affect the 2' hydroxyl group involved in RNase cleavage are 2'-H and 2'-O-alkyl, including 2'-O-Me. Modifications such as bicyclic ribose analogs, UNA, and modified internucleoside linkages of the residues at the YA site can be YA modifications. Exemplary base modifications that can stabilize RNA structures are pseudouridine and 5-methylcytosine. In some embodiments, at least one nucleotide of the YA site is modified. In some embodiments, the pyrimidine (also called "pyrimidine position") of the YA site comprises a modification (which includes a modification altering the internucleoside linkage immediately 3' of the sugar of the pyrimidine, a modification of the pyrimidine base, and a modification of the ribose, e.g. at its 2' position). In some embodiments, the adenine (also called "adenine position") of the YA site comprises a modification (which includes a modification altering the internucleoside linkage immediately 3' of the sugar of the pyrimidine, a modification of the pyrimidine base, and a modification of the ribose, e.g. at its 2' position). In some embodiments, the pyrimidine and the adenine of the YA site comprise modifications. In some embodiments, the YA modification reduces RNA endonuclease activity.

In some embodiments, an sgRNA comprises modifications at 1, 2, 3, 4, 5, 6, 7, 8, 9, 10, 11, 12, 13, 14, 15, 16, or more YA sites. In some embodiments, the pyrimidine of the YA site comprises a modification (which includes a modification altering the internucleoside linkage immediately 3' of the sugar of the pyrimidine). In some embodiments, the adenine of the YA site comprises a modification (which includes a modification altering the internucleoside linkage immediately 3' of the sugar of the adenine). In some embodiments, the pyrimidine and the adenine of the YA site comprise modifications, such as sugar, base, or internucleoside linkage modifications. The YA modifications can be any of the types of modifications set forth herein. In some embodiments, the YA modifications comprise one or more of phosphorothioate, 2'-O-Me, or 2'-fluoro. In some embodiments, the YA modifications comprise pyrimidine modifications comprising one or more of phosphorothioate, 2'-O-Me, or 2'-fluoro. In some embodiments, the YA modification comprises a bicyclic ribose analog (e.g., an LNA, BNA, or ENA) within an RNA duplex region that contains one or more YA sites. In some embodiments, the YA modification comprises a bicyclic ribose analog (e.g., an LNA, BNA, or ENA) within an RNA duplex region that contains a YA site, wherein the YA modification is distal to the YA site.

In some embodiments, the sgRNA comprises a guide region YA site modification. In some embodiments, the guide region comprises 1, 2, 3, 4, 5, or more YA sites ("guide region YA sites") that may comprise YA modifications. In some embodiments, one or more YA sites located at 5-end, 6-end, 7-end, 8-end, 9-end, or 10-end from the 5' end of the 5' terminus (where "5-end", etc., refers to position 5 to the 3' end of the guide region, i.e., the most 3' nucleotide in the guide region) comprise YA modifications. In some embodiments, two or more YA sites located at 5-end, 6-end, 7-end, 8-end, 9-end, or 10-end from the 5' end of the 5' terminus comprise YA modifications. In some embodiments, three or more YA sites located at 5-end, 6-end, 7-end, 8-end, 9-end, or 10-end from the 5' end of the 5' terminus comprise YA modifications. In some embodiments, four or more YA sites located at 5-end, 6-end, 7-end, 8-end, 9-end, or 10-end from the 5' end of the 5' terminus comprise YA modifications. In some embodiments, five or more YA sites located at 5-end, 6-end, 7-end, 8-end, 9-end, or 10-end from the 5' end of the 5' terminus comprise YA modifications. A modified guide region YA site comprises a YA modification.

In some embodiments, a modified guide region YA site is within 17, 16, 15, 14, 13, 12, 11, 10, or 9 nucleotides of the 3' terminal nucleotide of the guide region. For example, if a modified guide region YA site is within 10 nucleotides of the 3' terminal nucleotide of the guide region and the guide region is 20 nucleotides long, then the modified nucleotide of the modified guide region YA site is located at any of positions 11-20. In some embodiments, a YA modification is located within a YA site 20, 19, 18, 17, 16, 15, 14, 13, 12, 11, 10, 9, 8, 7, 6, 5, 4, 3, 2, or 1 nucleotides from the 3' terminal nucleotide of the guide region. In some embodiments, a YA modification is located 20, 19, 18, 17, 16, 15, 14, 13, 12, 11, 10, 9, 8, 7, 6, 5, 4, 3, 2, or 1 nucleotides from the 3' terminal nucleotide of the guide region.

In some embodiments, a modified guide region YA site is at or after nucleotide 4, 5, 6, 7, 8, 9, 10, or 11 from the 5' end of the 5' terminus.

In some embodiments, a modified guide region YA site is other than a 5' end modification. For example, an sgRNA can comprise a 5' end modification as described herein and further comprise a modified guide region YA site. Alternatively, an sgRNA can comprise an unmodified 5' end and a modified guide region YA site. Alternatively, an sgRNA can comprise a modified 5' end and an unmodified guide region YA site.

In some embodiments, a modified guide region YA site comprises a modification that at least one nucleotide located 5' of the guide region YA site does not comprise. For example, if nucleotides 1-3 comprise phosphorothioates, nucleotide 4 comprises only a 2'-O-Me modification, and nucleotide 5 is the pyrimidine of a YA site and comprises a phosphorothioate, then the modified guide region YA site comprises a modification (phosphorothioate) that at least one nucleotide located 5' of the guide region YA site (nucleotide 4) does not comprise. In another example, if nucleotides 1-3 comprise phosphorothioates, and nucleotide 4 is the pyrimidine of a YA site and comprises a 2'-O-Me, then the modified guide region YA site comprises a modification (2'-O-Me) that at least one nucleotide located 5' of the guide region YA site (any of nucleotides 1-3) does not comprise. This condition is also always satisfied if an unmodified nucleotide is located 5' of the modified guide region YA site.

In some embodiments, the modified guide region YA sites comprise modifications as described for YA sites above.

Additional embodiments of guide region YA site modifications are set forth in the summary above. Any embodiments set forth elsewhere in this disclosure may be combined to the extent feasible with any of the foregoing embodiments.

In some embodiments, the sgRNA comprises a conserved region YA site modification. Conserved region YA sites 1-10 are illustrated in FIG. 14. In some embodiments, 1, 2, 3, 4, 5, 6, 7, 8, 9, or 10 conserved region YA sites comprise modifications.

In some embodiments, conserved region YA sites 1, 8, or 1 and 8 comprise YA modifications. In some embodiments, conserved region YA sites 1, 2, 3, 4, and 10 comprise YA modifications. In some embodiments, YA sites 2, 3, 4, 8, and 10 comprise YA modifications. In some embodiments, conserved region YA sites 1, 2, 3, and 10 comprise YA modifications. In some embodiments, YA sites 2, 3, 8, and 10 comprise YA modifications. In some embodiments, YA sites 1, 2, 3, 4, 8, and 10 comprise YA modifications. In some embodiments, 1, 2, 3, 4, 5, 6, 7, or 8 additional conserved region YA sites comprise YA modifications.

In some embodiments, 1, 2, 3, or 4 of conserved region YA sites 2, 3, 4, and 10 comprise YA modifications. In some embodiments, 1, 2, 3, 4, 5, 6, 7, or 8 additional conserved region YA sites comprise YA modifications.

In some embodiments, the modified conserved region YA sites comprise modifications as described for YA sites above.

Additional embodiments of conserved region YA site modifications are set forth in the summary above. Any embodiments set forth elsewhere in this disclosure may be combined to the extent feasible with any of the foregoing embodiments.

In some embodiments, an sgRNA comprising the guide sequence of any one of SEQ ID NOs: 1-149 and any conserved portion of an sgRNA shown in Table 4, optionally having a modification pattern of any of an sgRNA shown in Table 4, optionally wherein the sgRNA comprises a 5' and 3' end modification (if not already shown in the construct of Table 4) is provided.

In some embodiments, the sgRNA comprises any of the modification patterns shown below in Table 4, where N is any natural or non-natural nucleotide, and wherein the totality of the Ns comprise a KLKB1 guide sequence as described herein in Table 1. Table 4 does not depict the guide sequence portion of the sgRNA. The modifications remain as shown in Table 4 despite the substitution of Ns for the nucleotides of a guide. That is, although the nucleotides of the guide replace the Ns, the nucleotides are modified as shown in Table 4.

TABLE 4 sgRNA modification patterns and conserved portions of an sgRNA. The guide sequence is not shown and will append the shown sequence at its 5' end.

| SEQ ID NO | Name | Sequence |
|---|---|---|
| 171 | Exemplary conserved portion | GUUUUAGAGCUAGAAAUAGCAAGUUAAAAUAAGGCUAGUCCGUUAUC AACUUGAAAAAGUGGCACCGAGUCGGUGCUUUU |
| 172 | Exemplary conserved portion | GUUUUAGAGCUAGAAAUAGCAAGUUAAAAUAAGGCUAGUCCGUUAUC AACUUGAAAAAGUGGCACCGAGUCGGUGC |
| 173 | Exemplary conserved portion | GUUUUAGAGCUAGAAAUAGCAAGUUAAAAUAAGGCUAGUCCGUUAUC AACUUGGCACCGAGUCGGUGC |
| 170 | Exemplary conserved portion | GUUUUAGAGCUAGAAAUAGCAAGUUAAAAUAAGGCUAGUCCGUUAUC AACUUGGCACCGAGUCGGUGCUUUU |
| 168 | Exemplary-mod only | GUUUUAGAGCUAGAAAUAGCAAGUUAAAAUAAGGCUAGUCCGUUAUC AACUUGAAAAAGUGGCACCGAGUCGGUGCmU*mU*mU*U |
| 169 | Exemplary-mod only | GUUUUAGAGCUAGAAAUAGCAAGUUAAAAUAAGGCUAGUCCGUUAUC AACUUGGCACCGAGUCGGUGCmU*mU*mU*U |
| 400 | Exemplary-mod only | GUUUUAGAGCUAGAAAUAGCAAGUUAAAAUAAGGCUAGUCCGUUAUC AACUUGAAAAAGUmGmGmCmAmCmCmGmAmGmUmCmGmGmUmGmCm U*mU*mU*mU |
| 401 | Exemplary-mod only | GUUUUAGAGCUAGAAAUAGCAAGUUAAAAUAAGGCUAGUCCGUUAUC AmAmCmUmUmGmAmAmAmAmAmGmUmGmGmCmAmCmCmGmAmGmU mCmGmGmUmGmCmU*mU*mU*mU |
| 402 | Exemplary-mod only | GUUUUAGAGCUAmGmAmAmAUAGCAAGUUAAAAUAAGGCUAGUCCGU UAUCAACUUGAAAAAGUGGCACCGAGUCGGUGCmU*mU*mU*U |
| 403 | Exemplary-mod only | GUUUUAGAmGmCmUmAGAAAmUmAmGmCAAGUUAAAAUAAGGCUAG UCCGUUAUCAACUUGAAAAAGUGGCACCGAGUCGGUGCmU*mU*mU*U |
| 404 | Exemplary-mod only | GUUUUAGAmGmCmUmAmGmAmAmAmUmAmGmCAAGUUAAAAUAAGG CUAGUCCGUUAUCAACUUGAAAAAGUGGCACCGAGUCGGUGCmU*mU* mU*U |
| 405 | Exemplary-mod only | GUUUUAGAmGmCmUmAmGmAmAmAmUmAmGmCAAGUUAAAAUAAGG CUAGUCCGUUAUCAmAmCmUmUmGmAmAmAmAmAmGmUmGmGmCmA mCmCmGmAmGmUmCmGmGmUmGmCmU*mU*mU*mU |
| 406 | Exemplary-mod only | mGUUUUmAGAmGmCmUmAmGmAmAmAmUmAmGmCAAGUUAAAAUAA GGCUAGUCCGUUAUCAmAmCmUmUmGmAmAmAmAmAmGmUmGmGmC mAmCmCmGmAmGmUmCmGmGmUmGmCmU*mU*mU*mU |

TABLE 4-continued sgRNA modification patterns and conserved portions of an sgRNA. The guide sequence is not shown and will append the shown sequence at its 5' end.

| SEQ ID NO | Name | Sequence |
|---|---|---|
| 407 | Exemplary-mod only | fGfUfUfUfUfAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmUmU*mU*mU |
| 408 | Exemplary-mod only | mGfUfUfUfUmAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 409 | Exemplary-mod only | GUUUUAGAmGmCmUmAmGmAmAmAmUmAmGmCAAGUmUmAAAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 410 | Exemplary-mod only | GUUUUAGAmGmCmUmAmGmAmAmAmUmAmGmCAAGUmUmAfAfAmAmUAAGGCUAGUCCGUUAUCAmAmCmUmUmGmAmAmAmAmAmGmUmGmGmCmAmCmCmGmAmGmUmCmGmGmUmGmCmUmU*mU*mU |
| 411 | Exemplary-mod only | GUUUUAGAmGmCmUmAmGmAmAmAmUmAmGmCAAGUfUmAfAmAfAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 412 | Exemplary mod only | mGUUUUmAGAmGmCmUmAmGmAmAmAmUmAmGmCAAGUmUmAAAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 413 | Exemplary-mod only | mGUUUUmAGAmGmCmUmAmGmAmAmAmUmAmGmCAAGUmUmAfAfAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 414 | Exemplary-mod only | mGUUUUmAGAmGmCmUmAmGmAmAmAmUmAmGmCAAGUfUmAfAmAfAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 415 | Exemplary-mod only | fGfUfUfUfUfAGAmGmCmUmAmGmAmAmAmUmAmGmCAAGUmUmAAAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 416 | Exemplary-mod only | fGfUfUfUfUfAGAmGmCmUmAmGmAmAmAmUmAmGmCAAGUmUmAfAfAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 417 | Exemplary-mod only | fGfUfUfUfUfAGAmGmCmUmAmGmAmAmAmUmAmGmCAAGUfUmAfAmAfAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 418 | Exemplary-mod only | GUUUUAmGmAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 419 | Exemplary-mod only | GUUUUAGAmGmCmUmAmGmAmAmAmUmAmGmCmAmAmGmUUAAAAUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 420 | Exemplary-mod only | GUUUUAGAmGmCmUmAmGmAmAmAmUmAmGmCAAGUUAAAAUAAGGCUAGUCCGUUfAfUfCfAmAmCmUmUmGmAmAmAmAmAmGmUmGmGmCmAmCmCmGmAmGmUmCmGmGmUmGmCmU*mU*mU*mU |
| 421 | Exemplary-mod only | GUUUUAGAmGmCmUmAmGmAmAmAmUmAmGmCAAGUUAAAAUAAGGCUAGUCCGUUAmUmCmAmAmCmUmUmGmAmAmAmAmAmGmUmGmGmCmAmCmCmGmAmGmUmCmGmGmUmGmCmU*mU*mU*mU |
| 422 | Exemplary-mod only | fGfUfUfUfUfAmGmAmGmCmUmAmGmAmAmAmUmAmGmCmAmAmGmUmUmAfAfAmAmUAAGGCUAGUCCGUUAmUmCmAmAmCmUmUmGmAmAmAmAmAmGmUmGmGmCmAmCmCmGmAmGmUmCmGmGmUmGmCmU*mU*mU*mU |
| 423 | Exemplary-mod only | GUUUUAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmUmUmUmU |
| 424 | Exemplary-mod only | GUUUUAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmUmU*mU*mU |

TABLE 4-continued

| sgRNA modification patterns and conserved portions of an sgRNA. The guide sequence is not shown and will append the shown sequence at its 5' end. | | |
|---|---|---|
| SEQ ID NO | Name | Sequence |
| 425 | Exemplary-mod only | GUUUUAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGfUfCfGfGfUfGfCfU*fU*fU*mU |
| 426 | Exemplary-mod only | GUUUUAGAmGmCmUmAmGmAmAmAmUmAmGmCAAGUUAAAAUAAGGCUAGUCCGUUAUCAfAmCfUmUfGmAfAmAfAmAfGmUfGmGfCmAfCmCfGmAfGmUfCmGfGmUfGmCfU*mU*fU*mU |
| 427 | Exemplary-mod only | mGUUUUmAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 428 | Exemplary mod only | fGfUfUfUfUfAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 429 | Exemplary-mod only | mGfUfUfUfUmAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 430 | Exemplary-mod only | GUUUUAGAmGmCmUmAmGmAmAmAmUmAmGmCAAGUmUmAAAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 431 | Exemplary mod only | GUUUUAGAmGmCmUmAmGmAmAmAmUmAmGmCAAGUmUmAfAfAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 432 | Exemplary-mod only | GUUUUAGAmGmCmUmAmGmAmAmAmUmAmGmCAAGUfUmAfAmAfAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 433 | Exemplary mod only | mGUUUUmAGAmGmCmUmAmGmAmAmAmUmAmGmCAAGUmUmAAAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 434 | Exemplary-mod only | mGUUUUmAGAmGmCmUmAmGmAmAmAmUmAmGmCAAGUmUmAfAfAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 435 | Exemplary-mod only | mGUUUUmAGAmGmCmUmAmGmAmAmAmUmAmGmCAAGUfUmAfAmAfAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 436 | Exemplary-mod only | fGfUfUfUfUfAGAmGmCmUmAmGmAmAmAmUmAmGmCAAGUmUmAAAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 437 | Exemplary-mod only | fGfUfUfUfUfAGAmGmCmUmAmGmAmAmAmUmAmGmCAAGUmUmAfAfAmAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 438 | Exemplary-mod only | fGfUfUfUfUfAGAmGmCmUmAmGmAmAmAmUmAmGmCAAGUfUmAfAmAfAmUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 439 | Exemplary-mod only | GUUUUAmGmAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 440 | Exemplary-mod only | GUUUUAGAmGmCmUmAmGmAmAmAmUmAmGmCmAmAmGmUUAAAAUAAGGCUAGUCCGUUAUCAmAmCmUmUmGmAmAmAmAmAmGmUmGmGmCmAmCmCmGmAmGmUmCmGmGmUmGmCmU*mU*mU*mU |
| 441 | Exemplary-mod only | GUUUUAGAmGmCmUmAmGmAmAmAmUmAmGmCAAGUUAAAAUAAGGCUAGUCCGUUfAfUfCfAmAmCmUmUmGmAmAmAmAmAmGmUmGmGmCmAmCmCmGmAmGmUmCmGmGmUmGmCmU*mU*mU*mU |
| 442 | Exemplary-mod only | GUUUUAGAmGmCmUmAmGmAmAmAmUmAmGmCAAGUUAAAAUAAGGCUAGUCCGUUAmUmCmAmAmCmUmUmGmAmAmAmAmAmGmUmGmGmCmAmCmCmGmAmGmUmCmGmGmUmGmCmU*mU*mU*mU |

TABLE 4-continued sgRNA modification patterns and conserved portions of an sgRNA. The guide sequence is not shown and will append the shown sequence at its 5' end.

| SEQ ID NO | Name | Sequence |
|---|---|---|
| 443 | Exemplary-mod only | fGfUfUfUfUfAmGmAmGmCmUmAmGmAmAmAmUmAmGmCmAmAmGmUmUmAfAfAmAmUAAGGCUAGUCCGUUAmUmCmAmAmCmUmUmGmAmAmAmAmAmGmUmGmGmCmAmCmCmGmAmGmUmCmGmGmUmGmCmU*mU*mU*mU |
| 444 | Exemplary-mod only | GUUUUAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmUmUmUmU |
| 445 | Exemplary-mod only | GUUUUAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGmUmCmGmGmUmGmCmUmU*mU*mU |
| 446 | Exemplary-mod only | GUUUUAGAmGmCmUmAmGmAmAmAmUmAmGmCAAGUUAAAAUAAGGCUAGUCCGUUAUCAmAmCmUmUmGmAmAmAmAmAmGmUmGmGmCmAmCmCmGmAmGfUfCfGfGfUfGfCfU*fU*fU*mU |
| 447 | Exemplary-mod only | GUUUUAGAmGmCmUmAmGmAmAmAmUmAmGmCAAGUUAAAAUAAGGCUAGUCCGUUAUCAfAmCfUmUfGmAfAmAfAmAfGmUfGmGfCmAfCmCfGmAfGmUfCmGfGmUfGmCfU*mU*fU*mU |
| 448 | Exemplary-guide region mod only | mN*mN*mN*mNNN*N*fN*fN*fN*fNNfNfNNNfNfNNN |
| 449 | Exemplary-guide region mod only | mN*mN*mN*mNNN*N*fN*fN*fN*fNNfNfNNN*fNfNNN |
| 450 | Exemplary-mod only | GUUUUAGAmGmCmUmAmGmAmAmAmUmAmGmCAAGUUAAAAUAAGGCUAGUCCGUUAUCAACUUGGCACCGAGUCGG*mU*mG*mC |
| 174 | Exemplary-mod only | GUUUUAGAGCUAGAAAUAGCAAGUUAAAAUAAGGCUAGUCCGUUAUCAACUAAGCACCGAGUCGG*mU*mG*mC |
| 175 | Exemplary-mod only | GUUUUAGAGCUAGAAAUAGCAAGUUAAAAUAAGGCUAGUCCGUUAUCAACUCAGCACCGAGUCGG*mU*mG*mC |
| 176 | Exemplary-mod only | GUUUUAGAGCUAGAAAUAGCAAGUUAAAAUAAGGCUAGUCCGUUAUCCACUUGGCACCGAGUCGG*mU*mG*mC |
| 177 | Exemplary-mod only | GUUUUAGAGCUAGAAAUAGCAAGUUAAAAUACGGCUAGUCCGUUAUCAACUUGGCACCGAGUCGG*mU*mG*mC |
| 178 | Exemplary-mod only | GUUUUAGAGCUAGAAAUAGCAAGUUAAAAUAAGGCUAGUCCGUUAUCAAGAGCUGGCACCGAGUCGG*mU*mG*mC |
| 179 | Exemplary-mod only | GUUUUAGAGCUAGAAAUAGCAAGUUAAAAUAAGGCUAGUCCGUUAUCAAGAAAUGGCACCGAGUCGG*mU*mG*mC |
| 180 | Exemplary-mod only | GUUUUAGAGCUAGAAAUAGCAAGUUAAAAUAAGGCUAGUCCGUUAUCACGAAAGGGCACCGAGUCGG*mU*mG*mC |
| 181 | Exemplary-mod only | GUUUUAGAGCUAGAAAUAGCAAGUUAAAAUAAGGCUAGUCCGUUAUCAAAAAUGGCACCGAGUCGG*mU*mG*mC |
| 182 | Exemplary mod only | GUUUUAGAGCUAGAAAUAGCAAGUUAAAAUAAGGCUAGUCCGUUAUCAAAAGUGGCACCGAGUCGG*mU*mG*mC |
| 183 | Exemplary-mod only | GUUUUAGAGCUAGAAAUAGCAAGUUAAAAUAAGGCUAGUCCGUUAUCAACAGUGGCACCGAGUCGG*mU*mG*mC |
| 184 | Exemplary mod only | GUUUUAGAGCUAGAAAUAGCAAGUUAAAAUAAGGCUAGUCCGUUAUCACAAGGGCACCGAGUCGG*mU*mG*mC |
| 185 | Exemplary-mod only | GUUUUAGAGCUAGAAAUAGCAAGUUAAAAUAAGGCUAGUCCGUUAUCAAAAUGGCACCGAGUCGG*mU*mG*mC |
| 186 | Exemplary-mod only | GUUUUAGAGCUAGAAAUAGCAAGUUAAAAUAAGGCUAGUCCGUUAUCAAAGGCACCGAGUCGG*mU*mG*mC |

TABLE 4-continued sgRNA modification patterns and conserved portions of an sgRNA. The guide sequence is not shown and will append the shown sequence at its 5' end.

| SEQ ID NO | Name | Sequence |
|---|---|---|
| 187 | Exemplary-mod only | GUUUUAGAGCUAGAAAUAGCAAGUUAAAAUAAGGCUAGUCCGUUAUCAAGGGCACCGAGUCGG*mU*mG*mC |
| 188 | Exemplary-mod only | GUUUUAGAGCUAGAAAUAGCAAGUUAAAAUAAGGCUAGUCCGUUAUCAGGCACCGAGUCGG*mU*mG*mC |
| 189 | Exemplary-mod only | GUUUUAGAGCUAGAAUAGCAAGUUAAAAUAAGGCUAGUCCGUUAUCAACUUGGCACCGAGUCGG*mU*mG*mC |
| 190 | Exemplary mod only | GUUUUAGAGCGCAAAGCGCAAGUUAAAAUAAGGCUAGUCCGUUAUCAACUUGGCACCGAGUCGG*mU*mG*mC |
| 191 | Exemplary-mod only | GUUUUAGAGCGCGAAGCGCAAGUUAAAAUAAGGCUAGUCCGUUAUCAACUUGGCACCGAGUCGG*mU*mG*mC |
| 192 | Exemplary mod only | GUUUUAGAGCGGAAACGCAAGUUAAAAUAAGGCUAGUCCGUUAUCAACUUGGCACCGAGUCGGU*mG*mC*mU |
| 193 | Exemplary-mod only | GUUUUAGAGCGGAAACGCAAGUUAAAAUAAGGCUAGUCCGUUAUCAACUUGGCACCGAGUCGG*mU*mG*mC |
| 194 | Exemplary-mod only | GUUUUAGAGCCGAAAGGCAAGUUAAAAUAAGGCUAGUCCGUUAUCAACUUGGCACCGAGUCGG*mU*mG*mC |
| 195 | Exemplary-mod only | GUUUUAGAGCUGAAAAGCAAGUUAAAAUAAGGCUAGUCCGUUAUCAACUUGGCACCGAGUCGG*mU*mG*mC |
| 196 | Exemplary-mod only | GUUUUAGAGCGAAAGCAAGUUAAAAUAAGGCUAGUCCGUUAUCAACUUGGCACCGAGUCGG*mU*mG*mC |
| 197 | Exemplary-mod only | GUUUUAGAGCGAAGCAAGUUAAAAUAAGGCUAGUCCGUUAUCAACUUGGCACCGAGUCGG*mU*mG*mC |
| 198 | Exemplary-mod only | GUUUUAGAGCAAAGCAAGUUAAAAUAAGGCUAGUCCGUUAUCAACUUGGCACCGAGUCGG*mU*mG*mC |
| 199 | Exemplary-mod only | GUUUUAGAGGAAACAAGUUAAAAUAAGGCUAGUCCGUUAUCAACUUGGCACCGAGUCGG*mU*mG*mC |
| 202 | Exemplary-mod only | GUUUUAGAGCAAGCAAGUUAAAAUAAGGCUAGUCCGUUAUCAACUUGGCACCGAGUCGG*mU*mG*mC |
| 203 | Exemplary-mod only | GUUUUAGAGCGAGCAAGUUAAAAUAAGGCUAGUCCGUUAUCAACUUGGCACCGAGUCGG*mU*mG*mC |
| 204 | Exemplary-mod only | GUUUUAGAGCGCAAGUUAAAAUAAGGCUAGUCCGUUAUCAACUUGGCACCGAGUCGG*mU*mG*mC |
| 205 | Exemplary-mod only | GUUUUAGAGAACAAGUUAAAAUAAGGCUAGUCCGUUAUCAACUUGGCACCGAGUCGG*mU*mG*mC |
| 206 | Exemplary-mod only | GUUUUAGAGACAAGUUAAAAUAAGGCUAGUCCGUUAUCAACUUGGCACCGAGUCGG*mU*mG*mC |
| 207 | Exemplary-mod only | GUUUUAGAGCAAGUUAAAAUAAGGCUAGUCCGUUAUCAACUUGGCACCGAGUCGG*mU*mG*mC |
| 208 | Exemplary-mod only | GUUUUAGAAAAAGUUAAAAUAAGGCUAGUCCGUUAUCAACUUGGCACCGAGUCGG*mU*mG*mC |
| 209 | Exemplary-mod only | GUUUUAGAAAAGUUAAAAUAAGGCUAGUCCGUUAUCAACUUGGCACCGAGUCGG*mU*mG*mC |
| 210 | Exemplary-mod only | GUUUUAGAGCUAGAAAUAGCAAGUUAAAAUAAGGCUAGUCCGUUAUCAACUUGGCACCGAGUCG*mG*mU*mG |
| 211 | Exemplary-mod only | GUUUUAGAGCUAGAAAUAGCAAGUUAAAAUAAGGCUAGUCCGUUAUCAACUUGGCACCGAGUC*mG*mG*mU |
| 212 | Exemplary-mod only | GUUUUAGAGCUAGAAAUAGCAAGUUAAAAUAAGGCUAGUCCGUUAUCAACUUGGCACCGAGU*mC*mG*mG |

TABLE 4-continued sgRNA modification patterns and conserved portions of an sgRNA. The guide sequence is not shown and will append the shown sequence at its 5' end.

| SEQ ID NO | Name | Sequence |
|---|---|---|
| 213 | Exemplary-mod only | GUUUUAGAGCUAGAAAUAGCAAGUUAAAAUAAGGCUAGUCCGUUAUCAACUUGGCACCGAG*mU*mC*mG |
| 214 | Exemplary-mod only | GUUUUAGAGCUAGAAAUAGCAAGUUAAAAUAAGGCUAGUCCGUUAUCAACUUGGCACCGA*mG*mU*mC |
| 215 | Exemplary-mod only | GUUUUAGAGCUAGAAAUAGCAAGUUAAAAUAAGGCUAGUCCGUUAUCAACUUGGCACCG*mA*mG*mU |
| 216 | Exemplary-mod only | GUUUUAGAGCGAAAGCAAGUUAAAAUAAGGCUAGUCCGUUAUCACUGGCACCGAGUCGG*mU*mG*mC |
| 217 | Exemplary-mod only | GUUUUAGAGCGAAAGCAAGUUAAAAUAAGGCUAGUCCGUUAUCAGGCACCGAGUCGG*mU*mG*mC |
| 218 | Exemplary-mod only | GUUUUAGAGAAAAAGUUAAAAUAAGGCUAGUCCGUUAUCAACUUGGCACCGAGUCGG*mU*mG*mC |
| 219 | Exemplary-mod only | GUUUUAGAGGAAACAAGUUAAAAUAAGGCUAGUCCGUUAUCAAUGGCACCGAGUCGG*mU*mG*mC |
| 220 | Exemplary-mod only | GUUUUAGAGAAAAAGUUAAAAUAAGGCUAGUCCGUUAUCAAUGGCACCGAGUCGG*mU*mG*mC |
| 221 | Exemplary-mod only | GUUUUAGAGGAAACAAGUUAAAAUAAGGCUAGUCCGUUAUCACUGGCACCGAGUCGG*mU*mG*mC |
| 222 | Exemplary-mod only | GUUUUAGAGAAAAAGUUAAAAUAAGGCUAGUCCGUUAUCAGGCACCGAGUCGG*mU*mG*mC |
| 223 | Exemplary-mod only | GUUUUAGAGCGAAAGCAAGUUAAAAUAAGGCUAGUCCGUUAUCAAGCUAUGGCACCGAGUCGG*mU*mG*mC |
| 224 | Exemplary-mod only | GUUUUAGAGCUAGAAAUAGCAAGUUAAAAUAAGGCAGUCCGUUAUCAACUUGGCACCGAGUCGG*mU*mG*mC |
| 225 | Exemplary-mod only | GUUUUAGAGCUAGAAAUAGCAAGUUAAAAUAAGGCUGUCCGUUAUCAACUUGGCACCGAGUCGG*mU*mG*mC |
| 226 | Exemplary-mod only | GUUUUAGAGCUAGAAAUAGCAAGUUAAAAUAAGGCGUCCGUUAUCAACUUGGCACCGAGUCGG*mU*mG*mC |
| 227 | Exemplary-mod only | GUUUUAGAGCUAGAAAUAGCAAGUUAAAAUAAGGUAUCCGUUAUCAACUUGGCACCGAGUCGG*mU*mG*mC |
| 228 | Exemplary-mod only | GUUUUAGAGCUAGAAAUAGCAAGUUAAAAUAAGGUUCCGUUAUCAACUUGGCACCGAGUCGG*mU*mG*mC |
| 229 | Exemplary-mod only | GUUUUAGAGCUAGAAAUAGCAAGUUAAAAUAAGGAUCCGUUAUCAACUUGGCACCGAGUCGG*mU*mG*mC |
| 230 | Exemplary-mod only | GUUUUCGAGCUAGAAAUAGCAAGUGAAAAUAAGGCUAGUCCGUUAUCAACUUGGCACCGAGUCGG*mU*mG*mC |
| 231 | Exemplary-mod only | GUUUUUGAGCUAGAAAUAGCAAGUAAAAAUAAGGCUAGUCCGUUAUCAACUUGGCACCGAGUCGG*mU*mG*mC |
| 232 | Exemplary-mod only | GUUUUAGAGCGAGAAAUCGCAAGUUAAAAUAAGGCUAGUCCGUUAUCAACUUGGCACCGAGUCGG*mU*mG*mC |
| 233 | Exemplary-mod only | GUUUUAGAGCUAGAAAUAGCGAGUUAAAAUAAGGCUAGUCCGUUAUCAACUUGGCACCGAGUCGG*mU*mG*mC |
| 234 | Exemplary-mod only | GUUUUAGAGCUAGAAAUAGCCGGUUAAAAUAAGGCUAGUCCGUUAUCAACUUGGCACCGAGUCGG*mU*mG*mC |
| 235 | Exemplary-mod only | GUUUUAGAGCUAGAAAUAGCAAGUUAAAAUGAGGCUAGUCCGUUAUCAACUUGGCACCGAGUCGG*mU*mG*mC |
| 236 | Exemplary-mod only | GUUUUAGAGCUAGAAAUAGCAAGUUAAAAUAAGGCUGGUCCGUUAUCAACUUGGCACCGAGUCGG*mU*mG*mC |

TABLE 4-continued sgRNA modification patterns and conserved portions of an sgRNA. The guide sequence is not shown and will append the shown sequence at its 5' end.

| SEQ ID NO | Name | Sequence |
|---|---|---|
| 237 | Exemplary-mod only | GUUUUAGAGCUAGAAAUAGCAAGUUAAAAUAAGGCUCGUCCGUUAUCAACUUGGCACCGAGUCGG*mU*mG*mC |
| 238 | Exemplary-mod only | GUUUUAGAGCUAGAAAUAGCAAGUUAAAAUAAGGCUUGUCCGUUAUCAACUUGGCACCGAGUCGG*mU*mG*mC |
| 239 | Exemplary-mod only | GUUUUAGAGCUAGAAAUAGCAAGUUAAAAUAAGGCUAGUCCGUUGUCAACUUGGCACCGAGUCGG*mU*mG*mC |
| 240 | Exemplary-mod only | GUUUUAGAGCUAGAAAUAGCAAGUUAAAAUAAGGCUAGUCCGUUCUCAACUUGGCACCGAGUCGG*mU*mG*mC |
| 241 | Exemplary-mod only | GUUUUAGAGCUAGAAAUAGCAAGUUAAAAUAAGGCUAGUCCGUUUUCAACUUGGCACCGAGUCGG*mU*mG*mC |
| 242 | Exemplary-mod only | GUUUUAGAGCUAGAAAUAGCAAGUUAAAAUAAGGCUAGUCCGUUAUGAACUUGGCACCGAGUCGG*mU*mG*mC |
| 243 | Exemplary-mod only | GUUUUAGAGCUAGAAAUAGCAAGUUAAAAUAAGGCUAGUCCGUUAUCAACUUGGGACCGAGUCGG*mU*mC*mC |
| 244 | Exemplary-mod only | GUUUUAGAGCUAGAAAUAGCAAGUUAAAAUAAGGCUAGUCCGUUAUCAACUUGGAACCGAGUCGG*mU*mU*mC |
| 245 | Exemplary mod only | GUUUUCGAGCGAGAAAUCGCGAGUGAAAAUGAGGCUGGUCCGUUGUGAACUUGGAACCGAGUCGG*mU*mU*mC |
| 246 | Exemplary-mod only | GUUUUUGAGCGAGAAAUCGCAAGUAAAAAUAAGGCUCGUCCGUUCUGAACUUGGAACCGAGUCGG*mU*mU*mC |
| 247 | Exemplary-mod only | GUUUCGGAGCCGGAAACGGCGAGUCGAAAUGAGGCUGGUCCGUUGUCGGCUCGGAACCGAGUCGG*mU*mU*mC |
| 248 | Exemplary-mod only | GUUUUAGAGCUAGAAAUAGCAAGUUAAAAUAAGGCUAGUCCGUUAUCAACUUGGCACCGAGUCGG*mU*mG*mC |
| 249 | Exemplary-mod only | GUUUUAGAGCUAGAAAUAGCAAGUUAAAAUAAGGCUAGUCCGUUAUCAACUUGGCACCGAGUCGG*mU*mG*mC |
| 250 | Exemplary-mod only | GUUUUAGAGCUAGAAAUAGCAAGUUAAAAUAAGGCUAGUCCGUUAUCAACUUGGCACCGAGUCGG*mU*mG*mC |
| 251 | Exemplary-mod only | GUUUUAGAGCUAGAAAUAGCAAGUUAAAAUAAGGCUAGUCCGUUAUCAACUUGGCACCGAGUCGG*mU*mG*mC |
| 252 | Exemplary-mod only | GUUUUAGAGCUAGAAAUAGCAAGUUAAAAUAAGGCUAGUCCGUUAUCAACUUGGCACCGAGUCGG*mU*mG*mC |
| 253 | Exemplary-mod only | GUUUUAGAGCUAGAAAUAGCAAGUUAAAAUAAGGCUAGUCCGUUAUCAACUUGGCACCGAGUCGG*mU*mG*mC |
| 254 | Exemplary-mod only | GUUUUAGAGCUAGAAAUAGCAAGUUAAAAUAAGGCUAGUCCGUUAUCAACUUGGCACCGAGUCGG*mU*mG*mC |
| 255 | Exemplary-mod only | GUUUUAGAGCUAGAAAUAGCAAGUUAAAAUAAGGCUAGUCCGUUAUCAACUUGGCACCGAGUCGG*mU*mG*mC |
| 256 | Exemplary-mod only | GUUUUAGAmGmCmUmAmGmAmAmAmUmAmGmCAAGUUAAAAUAAGGCUAGUCCGUUAUCACGAAAGGGCACCGAGUCGG*mU*mG*mC |
| 257 | Exemplary-mod only | GUUUUAGAmGmCmUmAmGmAmAmAmUmAmGmCAAGUUAAAAUAAGGCUAGUCCGUUAUCAAAAAUGGCACCGAGUCGG*mU*mG*mC |
| 258 | Exemplary-mod only | GUUUUAGAmGmCmUmAmGmAmAmAmUmAmGmCAAGUUAAAAUAAGGCUAGUCCGUUAUCACAAGGGCACCGAGUCGG*mU*mG*mC |

TABLE 4-continued sgRNA modification patterns and conserved portions of an sgRNA. The guide sequence is not shown and will append the shown sequence at its 5' end.

| SEQ ID NO | Name | Sequence |
|---|---|---|
| 259 | Exemplary-mod only | GUUUUAGAmGmCmUmAmGmAmAmAmUmAmGmCAAGUUAAAAUAAGGCUAGUCCGUUAUCAAAAUGGCACCGAGUCGG*mU*mG*mC |
| 260 | Exemplary-mod only | GUUUUAGAGCGCGAAGCGCAAGUUAAAAUAAGGCUAGUCCGUUAUCAAAAUGGCACCGAGUCGG*mU*mG*mC |
| 261 | Exemplary-mod only | GUUUUAGAGCUGAAAAGCAAGUUAAAAUAAGGCUAGUCCGUUAUCAAAAUGGCACCGAGUCGG*mU*mG*mC |
| 262 | Exemplary-mod only | GUUUUAGAGCGAAAGCAAGUUAAAAUAAGGCUAGUCCGUUAUCAAAAUGGCACCGAGUCGG*mU*mG*mC |
| 263 | Exemplary-mod only | GUUUUAGAGCAAAGCAAGUUAAAAUAAGGCUAGUCCGUUAUCAAAAUGGCACCGAGUCGG*mU*mG*mC |
| 264 | Exemplary-mod only | GUUUUAGAmGmCmGmAmAmAmGmCAAGUUAAAAUAAGGCUAGUCCGUUAUCAACUUGGCACCGAGUCGG*mU*mG*mC |
| 265 | Exemplary-mod only | GUUUUAGAmGmCmGmAmAmAmGmCAAGUUAAAAUAAGGCUAGUCCGUUAUCAAGAAAUGGCACCGAGUCGG*mU*mG*mC |
| 266 | Exemplary-mod only | GUUUUAGAmGmCmUmAmGmAmAmAmUmAmGmCAAGUUAAAAUAAGGCUAGUCCGUUAUCAmCmGmAmAmAmGmGmGmCmAmCmCmGmAmGmUmCmGmG*mU*mG*mC |
| 267 | Exemplary-mod only | GUUUUAGAmGmCmUmAmGmAmAmAmUmAmGmCAAGUUAAAAUAAGGCUAGUCCGUUAUCAmAmAmAmUmGmGmCmAmCmCmGmAmGmUmCmGmG*mU*mG*mC |
| 268 | Exemplary-mod only | GUUUUAGAmGmCmUmAmGmAmAmAmUmAmGmCAAGUUAAAAUAAGGCUAGUCCGUUAUCACmGmAmAmAmGmGmGmCmAmCmCmGmAmGmUmCmGmG*mU*mG*mC |
| 269 | Exemplary-mod only | GUUUUAGAmGmCmUmAmGmAmAmAmUmAmGmCAAGUUAAAAUAAGGCUAGUCCGUUAUCAAmAmAmUmGmGmCmAmCmCmGmAmGmUmCmGmG*mU*mG*mC |

In some embodiments, the modified sgRNA comprises the following sequence: mN*mN*mN*NNNNNNNNNNNNNNNNGUUUUAGAmGmCmUmAmGmAmAmAmUmAmGmCAAGUUAAAAUAAGGCUAGUCCGUJUAU-CAmAmCmUmUmGmAmAmAm AmAmG-mUmGmGmCmAmCmCmGmAmGmUmCmGm GmUmGmCmU*mU*mU*mU (SEQ ID NO: 300), where "N" may be any natural or non-natural nucleotide, and wherein the totality of Ns comprise a KLKB1 guide sequence as described in Table 1. For example, encompassed herein is SEQ ID NO: 300, where the Ns are replaced with any of the guide sequences disclosed herein in Table 1 (SEQ ID Nos: 1-149). Also encompassed herein are guide RNAs combining any of the guide sequences of Table 1 (SEQ ID Nos: 1-149) combined with a conserved portion of an sgRNA, e.g. a sequence of Table 4.

Any of the modifications described below may be present in the gRNAs and mRNAs described herein.

The terms "mA," "mC," "mU," or "mG" may be used to denote a nucleotide that has been modified with 2'-O-Me.

Modification of 2'-O-methyl can be depicted as follows:

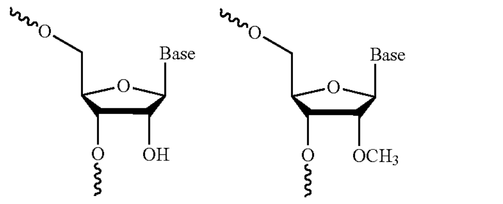

RNA 2'-O-Me

Another chemical modification that has been shown to influence nucleotide sugar rings is halogen substitution. For example, 2'-fluoro (2'-F) substitution on nucleotide sugar rings can increase oligonucleotide binding affinity and nuclease stability.

In this application, the terms "fA," "fC," "fU," or "fG" may be used to denote a nucleotide that has been substituted with 2'-F.

Substitution of 2'-F can be depicted as follows:

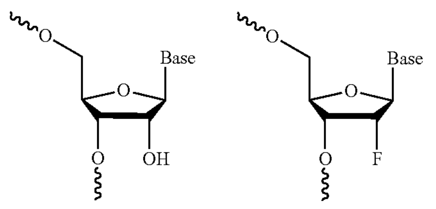

RNA — Natural composition of RNA

2'F-RNA — 2'F substitution

Phosphorothioate (PS) linkage or bond refers to a bond where a sulfur is substituted for one nonbridging phosphate oxygen in a phosphodiester linkage, for example in the bonds between nucleotides bases. When phosphorothioates are used to generate oligonucleotides, the modified oligonucleotides may also be referred to as S-oligos.

A "*" may be used to depict a PS modification. In this application, the terms A*, C*, U*, or G* may be used to denote a nucleotide that is linked to the next (e.g., 3') nucleotide with a PS bond.

In this application, the terms "mA*," "mC*," "mU*," or "mG*" may be used to denote a nucleotide that has been substituted with 2'-O-Me and that is linked to the next (e.g., 3') nucleotide with a PS bond.

The diagram below shows the substitution of S— into a nonbridging phosphate oxygen, generating a PS bond in lieu of a phosphodiester bond:

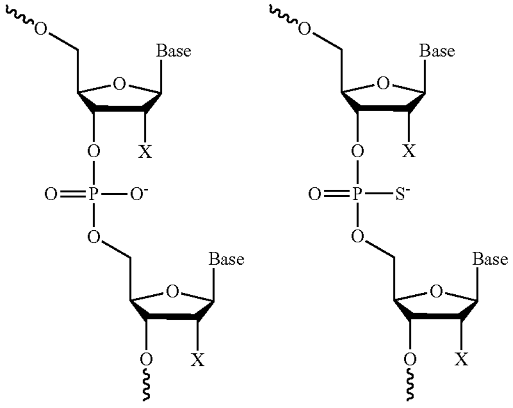

Phosphodiester — Natural phosphodiester linkage of RNA

Phosphorothioate (PS) — Modified phosphorothiate (PS) bond

Abasic nucleotides refer to those which lack nitrogenous bases. The figure below depicts an oligonucleotide with an abasic (also known as apurinic) site that lacks a base:

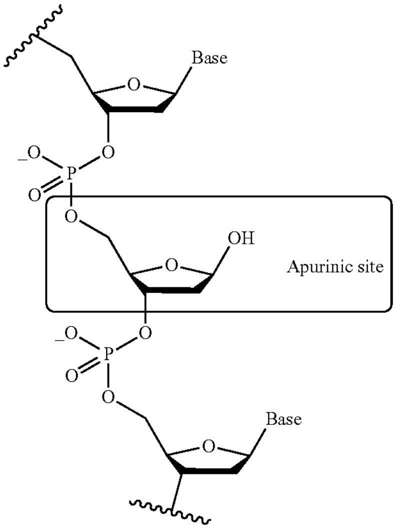

Inverted bases refer to those with linkages that are inverted from the normal 5' to 3' linkage (i.e., either a 5' to 5' linkage or a 3' to 3' linkage). For example:

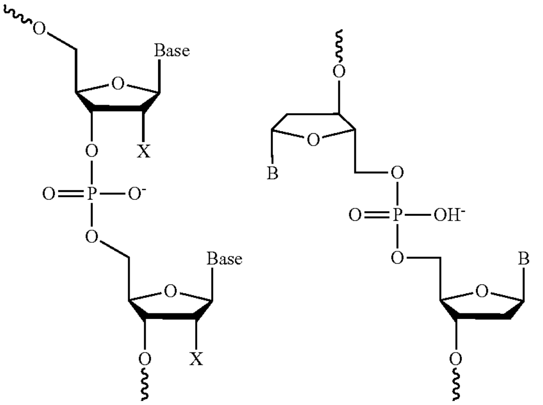

Normal oligonucleotide linkage

Inverted oligonucleotide linkage

An abasic nucleotide can be attached with an inverted linkage. For example, an abasic nucleotide may be attached to the terminal 5' nucleotide via a 5' to 5' linkage, or an abasic nucleotide may be attached to the terminal 3' nucleotide via a 3' to 3' linkage. An inverted abasic nucleotide at either the terminal 5' or 3' nucleotide may also be called an inverted abasic end cap.

In some embodiments, one or more of the first three, four, or five nucleotides at the 5' terminus, and one or more of the last three, four, or five nucleotides at the 3' terminus are modified. In some embodiments, the modification is a 2'-O-Me, 2'-F, inverted abasic nucleotide, PS bond, or other nucleotide modification well known in the art to increase stability and/or performance.

In some embodiments, the first four nucleotides at the 5' terminus, and the last four nucleotides at the 3' terminus are linked with phosphorothioate (PS) bonds.

In some embodiments, the first three nucleotides at the 5' terminus, and the last three nucleotides at the 3' terminus comprise a 2'-O-methyl (2'-O-Me) modified nucleotide. In some embodiments, the first three nucleotides at the 5' terminus, and the last three nucleotides at the 3' terminus comprise a 2'-fluoro (2'-F) modified nucleotide. In some embodiments, the first three nucleotides at the 5' terminus, and the last three nucleotides at the 3' terminus comprise an inverted abasic nucleotide.

In some embodiments, the guide RNA comprises a modified sgRNA. In some embodiments, the guide RNA comprises any conserved portion of an sgRNA shown in Table 4, optionally having a modification pattern of any of an sgRNA shown in Table 4, optionally wherein the sgRNA comprises a 5' and 3' end modification (if not already shown in the construct of Table 4) is provided. In some embodiments, the sgRNA comprises the modification pattern of any of an sgRNA shown in Table 4, where N is any natural or non-natural nucleotide, and where the totality of the Ns comprise a guide sequence that directs a nuclease to a target sequence in KLKB1, e.g., as shown in Table 1.

In some embodiments, the guide RNA comprises an sgRNA comprising any one of the guide sequences of SEQ ID No: 1-149 and any conserved portion of an sgRNA shown in Table 4, optionally having a modification pattern of any of an sgRNA shown in Table 4, optionally wherein the sgRNA comprises a 5' and 3' end modification (if not already shown in the construct of Table 4). In some embodiments, the guide RNA comprises an sgRNA comprising any one of the guide sequences of SEQ ID No: 1-149 and the nucleotides of SEQ ID No: 170, 171, 172, or 173, wherein the nucleotides of SEQ ID No: 170, 171, 172, or 173 are on the 3' end of the guide sequence, and wherein the sgRNA may be modified as shown in Table 4 or SEQ ID NO: 300.

As noted above, in some embodiments, a composition or formulation disclosed herein comprises an mRNA comprising an open reading frame (ORF) encoding an RNA-guided DNA binding agent, such as a Cas nuclease as described herein. In some embodiments, an mRNA comprising an ORF encoding an RNA-guided DNA binding agent, such as a Cas nuclease, is provided, used, or administered. In some embodiments, the ORF encoding an RNA-guided DNA nuclease is a "modified RNA-guided DNA binding agent ORF" or simply a "modified ORF," which is used as shorthand to indicate that the ORF is modified.

In some embodiments, the modified ORF may comprise a modified uridine at least at one, a plurality of, or all uridine positions. In some embodiments, the modified uridine is a uridine modified at the 5 position, e.g., with a halogen, methyl, or ethyl. In some embodiments, the modified uridine is a pseudouridine modified at the 1 position, e.g., with a halogen, methyl, or ethyl. The modified uridine can be, for example, pseudouridine, N1-methyl-pseudouridine, 5-methoxyuridine, 5-iodouridine, or a combination thereof. In some embodiments, the modified uridine is 5-methoxyuridine. In some embodiments, the modified uridine is 5-iodouridine. In some embodiments, the modified uridine is pseudouridine. In some embodiments, the modified uridine is N1-methyl-pseudouridine. In some embodiments, the modified uridine is a combination of pseudouridine and N1-methyl-pseudouridine. In some embodiments, the modified uridine is a combination of pseudouridine and 5-methoxyuridine. In some embodiments, the modified uridine is a combination of N1-methyl pseudouridine and 5-methoxyuridine. In some embodiments, the modified uridine is a combination of 5-iodouridine and N1-methyl-pseudouridine. In some embodiments, the modified uridine is a combination of pseudouridine and 5-iodouridine. In some embodiments, the modified uridine is a combination of 5-iodouridine and 5-methoxyuridine.

In some embodiments, an mRNA disclosed herein comprises a 5' cap, such as a Cap0, Cap1, or Cap2. A 5' cap is generally a 7-methylguanine ribonucleotide (which may be further modified, as discussed below e.g. with respect to ARCA) linked through a 5'-triphosphate to the 5' position of the first nucleotide of the 5'-to-3' chain of the mRNA, i.e., the first cap-proximal nucleotide. In Cap0, the riboses of the first and second cap-proximal nucleotides of the mRNA both comprise a 2'-hydroxyl. In Cap1, the riboses of the first and second transcribed nucleotides of the mRNA comprise a 2'-methoxy and a 2'-hydroxyl, respectively. In Cap2, the riboses of the first and second cap-proximal nucleotides of the mRNA both comprise a 2'-methoxy. See, e.g., Katibah et al. (2014) *Proc Natl Acad Sci USA* 111(33):12025-30; Abbas et al. (2017) *Proc Natl Acad Sci USA* 114(11):E2106-E2115. Most endogenous higher eukaryotic mRNAs, including mammalian mRNAs such as human mRNAs, comprise Cap1 or Cap2. Cap0 and other cap structures differing from Cap1 and Cap2 may be immunogenic in mammals, such as humans, due to recognition as "non-self" by components of the innate immune system such as IFIT-1 and IFIT-5, which can result in elevated cytokine levels including type I interferon. Components of the innate immune system such as IFIT-1 and IFIT-5 may also compete with eIF4E for binding of an mRNA with a cap other than Cap1 or Cap2, potentially inhibiting translation of the mRNA.

A cap can be included co-transcriptionally. For example, ARCA (anti-reverse cap analog; ThermoFisher Scientific Cat. No. AM8045) is a cap analog comprising a 7-methylguanine 3'-methoxy-5'-triphosphate linked to the 5' position of a guanine ribonucleotide which can be incorporated in vitro into a transcript at initiation. ARCA results in a Cap0 cap in which the 2' position of the first cap-proximal nucleotide is hydroxyl. See, e.g., Stepinski et al., (2001) "Synthesis and properties of mRNAs containing the novel 'anti-reverse' cap analogs 7-methyl(3'-O-methyl)GpppG and 7-methyl(3'deoxy)GpppG," *RNA* 7: 1486-1495. The ARCA structure is shown below.

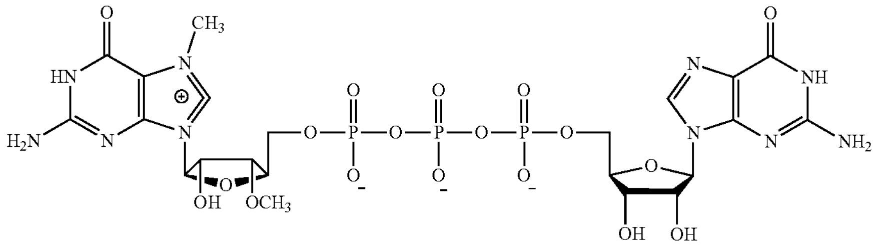

CleanCap® AG (m7G(5')ppp(5')(2'OMeA)pG; TriLink Biotechnologies Cat. No. N-7113) or CleanCap® GG (m7G (5')ppp(5')(2'OMeG)pG; TriLink Biotechnologies Cat. No. N-7133) can be used to provide a Cap1 structure co-transcriptionally. 3'-O-methylated versions of CleanCap® AG and CleanCap® GG are also available from TriLink Biotechnologies as Cat. Nos. N-7413 and N-7433, respectively. The CleanCap® AG structure is shown below.

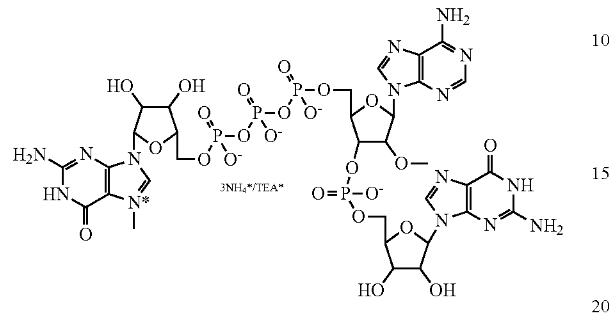

Alternatively, a cap can be added to an RNA post-transcriptionally. For example, Vaccinia capping enzyme is commercially available (New England Biolabs Cat. No. M2080S) and has RNA triphosphatase and guanylyltransferase activities, provided by its D1 subunit, and guanine methyltransferase, provided by its D12 subunit. As such, it can add a 7-methylguanine to an RNA, so as to give Cap0, in the presence of S-adenosyl methionine and GTP. See, e.g., Guo, P. and Moss, B. (1990) *Proc. Natl. Acad. Sci. USA* 87, 4023-4027; Mao, X. and Shuman, S. (1994) *J. Biol. Chem.* 269, 24472-24479.

In some embodiments, the mRNA further comprises a poly-adenylated (poly-A) tail. In some embodiments, the poly-A tail comprises at least 20, 30, 40, 50, 60, 70, 80, 90, or 100 adenines, optionally up to 300 adenines. In some embodiments, the poly-A tail comprises 95, 96, 97, 98, 99, or 100 adenine nucleotides.

D. Ribonucleoprotein Complex

In some embodiments, the disclosure provides compositions comprising one or more gRNAs comprising one or more guide sequences from Table 1 or 2 and an RNA-guided DNA binding agent, e.g., a nuclease, such as a Cas nuclease, such as Cas9. In some embodiments, the RNA-guided DNA-binding agent has cleavase activity, which can also be referred to as double-strand endonuclease activity. In some embodiments, the RNA-guided DNA-binding agent comprises a Cas nuclease. Examples of Cas9 nucleases include those of the type II CRISPR systems of *S. pyogenes, S. aureus*, and other prokaryotes (see, e.g., the list in the next paragraph), and modified (e.g., engineered or mutant) versions thereof. See, e.g., US2016/0312198 A1; US 2016/0312199 A1. Other examples of Cas nucleases include a Csm or Cmr complex of a type III CRISPR system or the Cas10, Csm1, or Cmr2 subunit thereof; and a Cascade complex of a type I CRISPR system, or the Cas3 subunit thereof. In some embodiments, the Cas nuclease may be from a Type-IIA, Type-IIB, or Type-IIC system. For discussion of various CRISPR systems and Cas nucleases see, e.g., Makarova et al., Nat. Rev. Microbiol. 9:467-477 (2011); Makarova et al., Nat. Rev. Microbiol, 13: 722-36 (2015); Shmakov et al., Molecular Cell, 60:385-397 (2015).

Non-limiting exemplary species that the Cas nuclease can be derived from include *Streptococcus pyogenes, Streptococcus thermophilus, Streptococcus* sp., *Staphylococcus aureus, Listeria innocua, Lactobacillus gasseri, Francisella novicida, Wolinella succinogenes, Sutterella wadsworthensis*, Gammaproteobacterium, *Neisseria meningitidis, Campylobacter jejuni, Pasteurella multocida, Fibrobacter succinogene, Rhodospirillum rubrum, Nocardiopsis dassonvillei, Streptomyces pristinaespiralis, Streptomyces viridochromogenes, Streptomyces viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Lactobacillus buchneri, Treponema denticola, Microscilla marina*, Burkholderiales bacterium, *Polaromonas naphthalenivorans, Polaromonas* sp., *Crocosphaera watsonii*, Cyanothece sp., *Microcystis aeruginosa, Synechococcus* sp., *Acetohalobium arabaticum, Ammonfex degensii, Caldicelulosiruptor becscii, Candidatus desulforudis, Clostridium botulinum, Clostridium difficile, Finegoldia magna, Natranaerobius thermophilus, Pelotomaculum thermopropionicum, Acidithiobacillus caldus, Acidithiobacillus ferrooxidans, Allochromatium vinosum, Marinobacter* sp., *Nitrosococcus halophilus, Nitrosococcus watsoni, Pseudoalteromonas haloplanktis, Ktedonobacter racemifer, Methanohalobium evestigatum, Anabaena variabilis, Nodularia spumigena, Nostoc* sp., *Arthrospira maxima, Arthrospira platensis, Arthrospira* sp., *Lyngbya* sp., *Microcoleus chthonoplastes, Oscillatoria* sp., *Petrotoga mobilis, Thermosipho africanus, Streptococcus pasteurianus, Neisseria cinerea, Campylobacter lari, Parvibaculum lavamentivorans, Corynebacterium diphtheria, Acidaminococcus* sp., *Lachnospiraceae bacterium* ND2006, and *Acaryochloris marina.*

In some embodiments, the Cas nuclease is the Cas9 nuclease from *Streptococcus pyogenes*. In some embodiments, the Cas nuclease is the Cas9 nuclease from *Streptococcus thermophilus*. In some embodiments, the Cas nuclease is the Cas9 nuclease from *Neisseria meningitidis*. In some embodiments, the Cas nuclease is the Cas9 nuclease is from *Staphylococcus aureus*. In some embodiments, the Cas nuclease is the Cpf1 nuclease from *Francisella novicida*. In some embodiments, the Cas nuclease is the Cpf1 nuclease from *Acidaminococcus* sp. In some embodiments, the Cas nuclease is the Cpf1 nuclease from *Lachnospiraceae bacterium* ND2006. In further embodiments, the Cas nuclease is the Cpf1 nuclease from *Francisella tularensis, Lachnospiraceae bacterium, Butyrivibrio proteoclasticus*, Peregrinibacteria bacterium, Parcubacteria bacterium, *Smithella, Acidaminococcus, Candidatus Methanoplasma termitum, Eubacterium eligens, Moraxella bovoculi, Leptospira inadai, Porphyromonas crevioricanis, Prevotella disiens*, or *Porphyromonas macacae*. In certain embodiments, the Cas nuclease is a Cpf1 nuclease from an *Acidaminococcus* or *Lachnospiraceae.*

In some embodiments, the gRNA together with an RNA-guided DNA binding agent is called a ribonucleoprotein complex (RNP). In some embodiments, the RNA-guided DNA binding agent is a Cas nuclease. In some embodiments, the gRNA together with a Cas nuclease is called a Cas RNP. In some embodiments, the RNP comprises Type-I, Type-II, or Type-III components. In some embodiments, the Cas nuclease is the Cas9 protein from the Type-II CRISPR/Cas system. In some embodiment, the gRNA together with Cas9 is called a Cas9 RNP.

Wild type Cas9 has two nuclease domains: RuvC and HNH. The RuvC domain cleaves the non-target DNA strand, and the HNH domain cleaves the target strand of DNA. In some embodiments, the Cas9 protein comprises more than one RuvC domain and/or more than one HNH domain. In some embodiments, the Cas9 protein is a wild type Cas9. In each of the composition, use, and method embodiments, the Cas induces a double strand break in target DNA.

In some embodiments, chimeric Cas nucleases are used, where one domain or region of the protein is replaced by a portion of a different protein. In some embodiments, a Cas nuclease domain may be replaced with a domain from a different nuclease such as Fok1. In some embodiments, a Cas nuclease may be a modified nuclease.

In other embodiments, the Cas nuclease may be from a Type-I CRISPR/Cas system. In some embodiments, the Cas nuclease may be a component of the Cascade complex of a Type-I CRISPR/Cas system. In some embodiments, the Cas nuclease may be a Cas3 protein. In some embodiments, the Cas nuclease may be from a Type-III CRISPR/Cas system. In some embodiments, the Cas nuclease may have an RNA cleavage activity.

In some embodiments, the RNA-guided DNA-binding agent has single-strand nickase activity, i.e., can cut one DNA strand to produce a single-strand break, also known as a "nick." In some embodiments, the RNA-guided DNA-binding agent comprises a Cas nickase. A nickase is an enzyme that creates a nick in dsDNA, i.e., cuts one strand but not the other of the DNA double helix. In some embodiments, a Cas nickase is a version of a Cas nuclease (e.g., a Cas nuclease discussed above) in which an endonucleolytic active site is inactivated, e.g., by one or more alterations (e.g., point mutations) in a catalytic domain. See, e.g., U.S. Pat. No. 8,889,356 for discussion of Cas nickases and exemplary catalytic domain alterations. In some embodiments, a Cas nickase such as a Cas9 nickase has an inactivated RuvC or HNH domain.

In some embodiments, the RNA-guided DNA-binding agent is modified to contain only one functional nuclease domain. For example, the agent protein may be modified such that one of the nuclease domains is mutated or fully or partially deleted to reduce its nucleic acid cleavage activity. In some embodiments, a nickase is used having a RuvC domain with reduced activity. In some embodiments, a nickase is used having an inactive RuvC domain. In some embodiments, a nickase is used having an HNH domain with reduced activity. In some embodiments, a nickase is used having an inactive HNH domain.

In some embodiments, a conserved amino acid within a Cas protein nuclease domain is substituted to reduce or alter nuclease activity. In some embodiments, a Cas nuclease may comprise an amino acid substitution in the RuvC or RuvC-like nuclease domain. Exemplary amino acid substitutions in the RuvC or RuvC-like nuclease domain include D10A (based on the *S. pyogenes* Cas9 protein). See, e.g., Zetsche et al. (2015) *Cell* October 22:163(3): 759-771. In some embodiments, the Cas nuclease may comprise an amino acid substitution in the HNH or HNH-like nuclease domain. Exemplary amino acid substitutions in the HNH or HNH-like nuclease domain include E762A, H840A, N863A, H983A, and D986A (based on the *S. pyogenes* Cas9 protein). See, e.g., Zetsche et al. (2015). Further exemplary amino acid substitutions include D917A, E1006A, and D1255A (based on the *Francisella novicida* U112 Cpf1 (FnCpf1) sequence (UniProtKB—A0Q7Q2 (CPF1_FRATN)).

In some embodiments, an mRNA encoding a nickase is provided in combination with a pair of guide RNAs that are complementary to the sense and antisense strands of the target sequence, respectively. In this embodiment, the guide RNAs direct the nickase to a target sequence and introduce a DSB by generating a nick on opposite strands of the target sequence (i.e., double nicking). In some embodiments, use of double nicking may improve specificity and reduce off-target effects. In some embodiments, a nickase is used together with two separate guide RNAs targeting opposite strands of DNA to produce a double nick in the target DNA. In some embodiments, a nickase is used together with two separate guide RNAs that are selected to be in close proximity to produce a double nick in the target DNA.

In some embodiments, the RNA-guided DNA-binding agent lacks cleavase and nickase activity. In some embodiments, the RNA-guided DNA-binding agent comprises a dCas DNA-binding polypeptide. A dCas polypeptide has DNA-binding activity while essentially lacking catalytic (cleavase/nickase) activity. In some embodiments, the dCas polypeptide is a dCas9 polypeptide. In some embodiments, the RNA-guided DNA-binding agent lacking cleavase and nickase activity or the dCas DNA-binding polypeptide is a version of a Cas nuclease (e.g., a Cas nuclease discussed above) in which its endonucleolytic active sites are inactivated, e.g., by one or more alterations (e.g., point mutations) in its catalytic domains. See, e.g., US 2014/0186958 A1; US 2015/0166980 A1.

In some embodiments, the RNA-guided DNA-binding agent comprises one or more heterologous functional domains (e.g., is or comprises a fusion polypeptide).

In some embodiments, the heterologous functional domain may facilitate transport of the RNA-guided DNA-binding agent into the nucleus of a cell. For example, the heterologous functional domain may be a nuclear localization signal (NLS). In some embodiments, the RNA-guided DNA-binding agent may be fused with 1-10 NLS(s). In some embodiments, the RNA-guided DNA-binding agent may be fused with 1-5 NLS(s). In some embodiments, the RNA-guided DNA-binding agent may be fused with one NLS. Where one NLS is used, the NLS may be linked at the N-terminus or the C-terminus of the RNA-guided DNA-binding agent sequence. It may also be inserted within the RNA-guided DNA binding agent sequence. In other embodiments, the RNA-guided DNA-binding agent may be fused with more than one NLS. In some embodiments, the RNA-guided DNA-binding agent may be fused with 2, 3, 4, or 5 NLSs. In some embodiments, the RNA-guided DNA-binding agent may be fused with two NLSs. In certain circumstances, the two NLSs may be the same (e.g., two SV40 NLSs) or different. In some embodiments, the RNA-guided DNA-binding agent is fused to two SV40 NLS sequences linked at the carboxy terminus. In some embodiments, the RNA-guided DNA-binding agent may be fused with two NLSs, one linked at the N-terminus and one at the C-terminus. In some embodiments, the RNA-guided DNA-binding agent may be fused with 3 NLSs. In some embodiments, the RNA-guided DNA-binding agent may be fused with no NLS. In some embodiments, the NLS may be a monopartite sequence, such as, e.g., the SV40 NLS, PKKKRKV (SEQ ID NO: 600) or PKKKRRV (SEQ ID NO: 601). In some embodiments, the NLS may be a bipartite sequence, such as the NLS of nucleoplasmin, KRPAATKKAGQAKKKK (SEQ ID NO: 602). In a specific embodiment, a single PKKKRKV (SEQ ID NO: 600) NLS may be linked at the C-terminus of the RNA-guided DNA-binding agent. One or more linkers are optionally included at the fusion site.

In some embodiments, the heterologous functional domain may be capable of modifying the intracellular half-life of the RNA-guided DNA binding agent. In some embodiments, the half-life of the RNA-guided DNA binding agent may be increased. In some embodiments, the half-life of the RNA-guided DNA-binding agent may be reduced. In some embodiments, the heterologous functional domain may be capable of increasing the stability of the RNA-guided DNA-binding agent. In some embodiments, the heterologous functional domain may be capable of reducing the stability of the RNA-guided DNA-binding agent. In some embodiments, the heterologous functional domain may act as a signal peptide for protein degradation. In some embodiments, the protein degradation may be mediated by proteolytic enzymes, such as, for example, proteasomes, lysosomal proteases, or calpain proteases. In some embodiments, the heterologous functional domain may comprise a PEST sequence. In some embodiments, the RNA-guided DNA-binding agent may be modified by addition of ubiquitin or a polyubiquitin chain. In some embodiments, the ubiquitin may be a ubiquitin-like protein (UBL). Non-limiting examples of ubiquitin-like proteins include small ubiquitin-like modifier (SUMO), ubiquitin cross-reactive protein (UCRP, also known as interferon-stimulated gene-15 (ISG15)), ubiquitin-related modifier-1 (URM1), neuronal-precursor-cell-expressed developmentally downregulated protein-8 (NEDD8, also called Rub1 in *S. cerevisiae*), human leukocyte antigen F-associated (FAT10), autophagy-8 (ATG8) and -12 (ATG12), Fau ubiquitin-like protein (FUB1), membrane-anchored UBL (MUB), ubiquitin fold-modifier-1 (UFM1), and ubiquitin-like protein-5 (UBL5).

In some embodiments, the heterologous functional domain may be a marker domain. Non-limiting examples of marker domains include fluorescent proteins, purification tags, epitope tags, and reporter gene sequences. In some embodiments, the marker domain may be a fluorescent protein. Non-limiting examples of suitable fluorescent proteins include green fluorescent proteins (e.g., GFP, GFP-2, tagGFP, turboGFP, sfGFP, EGFP, Emerald, Azami Green, Monomeric Azami Green, CopGFP, AceGFP, ZsGreen1), yellow fluorescent proteins (e.g., YFP, EYFP, Citrine, Venus, YPet, PhiYFP, ZsYellow1), blue fluorescent proteins (e.g., EBFP, EBFP2, Azurite, mKalamal, GFPuv, Sapphire, T-sapphire,), cyan fluorescent proteins (e.g., ECFP, Cerulean, CyPet, AmCyan1, Midoriishi-Cyan), red fluorescent proteins (e.g., mKate, mKate2, mPlum, DsRed monomer, mCherry, mRFP1, DsRed-Express, DsRed2, DsRed-Monomer, HcRed-Tandem, HcRed1, AsRed2, eqFP611, mRasberry, mStrawberry, Jred), and orange fluorescent proteins (mOrange, mKO, Kusabira-Orange, Monomeric Kusabira-Orange, mTangerine, tdTomato) or any other suitable fluorescent protein. In other embodiments, the marker domain may be a purification tag and/or an epitope tag. Non-limiting exemplary tags include glutathione-S-transferase (GST), chitin binding protein (CBP), maltose binding protein (MBP), thioredoxin (TRX), poly(NANP), tandem affinity purification (TAP) tag, myc, AcV5, AU1, AU5, E, ECS, E2, FLAG, HA, nus, Softag 1, Softag 3, Strep, SBP, Glu-Glu, HSV, KT3, S, S1, T7, V5, VSV-G, 6×His, 8×His, biotin carboxyl carrier protein (BCCP), poly-His, and calmodulin. Non-limiting exemplary reporter genes include glutathione-S-transferase (GST), horseradish peroxidase (HRP), chloramphenicol acetyltransferase (CAT), beta-galactosidase, beta-glucuronidase, luciferase, or fluorescent proteins.

In additional embodiments, the heterologous functional domain may target the RNA-guided DNA-binding agent to a specific organelle, cell type, tissue, or organ. In some embodiments, the heterologous functional domain may target the RNA-guided DNA-binding agent to mitochondria.

In further embodiments, the heterologous functional domain may be an effector domain. When the RNA-guided DNA-binding agent is directed to its target sequence, e.g., when a Cas nuclease is directed to a target sequence by a gRNA, the effector domain may modify or affect the target sequence. In some embodiments, the effector domain may be chosen from a nucleic acid binding domain, a nuclease domain (e.g., a non-Cas nuclease domain), an epigenetic modification domain, a transcriptional activation domain, or a transcriptional repressor domain. In some embodiments, the heterologous functional domain is a nuclease, such as a FokI nuclease. See, e.g., U.S. Pat. No. 9,023,649. In some embodiments, the heterologous functional domain is a transcriptional activator or repressor. See, e.g., Qi et al., "Repurposing CRISPR as an RNA-guided platform for sequence-specific control of gene expression," *Cell* 152:1173-83 (2013); Perez-Pinera et al., "RNA-guided gene activation by CRISPR-Cas9-based transcription factors," *Nat. Methods* 10:973-6 (2013); Mali et al., "CAS9 transcriptional activators for target specificity screening and paired nickases for cooperative genome engineering," *Nat. Biotechnol.* 31:833-8 (2013); Gilbert et al., "CRISPR-mediated modular RNA-guided regulation of transcription in eukaryotes," *Cell* 154:442-51 (2013). As such, the RNA-guided DNA-binding agent essentially becomes a transcription factor that can be directed to bind a desired target sequence using a guide RNA.

E. Determination of Efficacy of gRNAs

In some embodiments, the efficacy of a gRNA is determined when delivered or expressed together with other components forming an RNP. In some embodiments, the gRNA is expressed together with an RNA-guided DNA binding agent, such as a Cas protein, e.g., Cas9. In some embodiments, the gRNA is delivered to or expressed in a cell line that already stably expresses an RNA-guided DNA nuclease, such as a Cas nuclease or nickase, e.g., Cas9 nuclease or nickase. In some embodiments the gRNA is delivered to a cell as part of an RNP. In some embodiments, the gRNA is delivered to a cell along with a mRNA encoding an RNA-guided DNA nuclease, such as a Cas nuclease or nickase, e.g., Cas9 nuclease or nickase.

As described herein, use of an RNA-guided DNA nuclease and a guide RNA disclosed herein can lead to double-stranded breaks (DSB), single-strand break, and/or site-specific binding that results in nucleic acid modification in the DNA which can produce errors in the form of insertion/deletion (indel) mutations upon repair by cellular machinery. Many mutations due to indels alter the reading frame or introduce premature stop codons and, therefore, produce a non-functional protein.

In some embodiments, the efficacy of particular gRNAs is determined based on in vitro models. In some embodiments, the in vitro model is HEK293 cells stably expressing Cas9 (HEK293_Cas9). In some embodiments, the in vitro model is HUH7 human hepatocarcinoma cells. In some embodiments, the in vitro model is HepG2 cells. In some embodiments, the in vitro model is primary human hepatocytes. In some embodiments, the in vitro model is primary cynomolgus hepatocytes. With respect to using primary human hepatocytes, commercially available primary human hepatocytes can be used to provide greater consistency between experiments. In some embodiments, the number of off-target sites at which a deletion or insertion occurs in an in vitro model (e.g., in primary human hepatocytes) is determined, e.g., by analyzing genomic DNA from primary human hepatocytes transfected in vitro with Cas9 mRNA and the guide RNA. In some embodiments, such a determination comprises analyzing genomic DNA from primary human hepatocytes transfected in vitro with Cas9 mRNA, the guide RNA, and a donor oligonucleotide. Exemplary procedures for such determinations are provided in the working examples below.

In some embodiments, the efficacy of particular gRNAs is determined across multiple in vitro cell models for a gRNA selection process. In some embodiments, a cell line comparison of data with selected gRNAs is performed. In some embodiments, cross screening in multiple cell models is performed. In some embodiments, the efficacy of particular gRNAs is determined in PHH or PCH for a gRNA selection process.

In some embodiments, the efficacy of particular gRNAs is determined based on in vivo models. In some embodiments, the in vivo model is a rodent model. In some embodiments, the rodent model is a mouse which expresses a KLKB1 gene. In some embodiments, the rodent model is a mouse which expresses a human KLKB1 gene. In some embodiments, the in vivo model is a non-human primate, for example cynomolgus monkey.

In some embodiments, the efficacy of a guide RNA is measured by percent editing of KLKB1. Indel percentage can be calculated from NGS sequencing. In some embodiments, the percent editing of KLKB1 is compared to the percent editing necessary to achieve knockdown of prekallikrein and/or kallikrein protein, e.g., from cell culture media or cell lysates in the case of an in vitro model or plasma containing circulating levels in the case of an in vivo model.

In some embodiments, the efficacy of a guide RNA is measured by the number and/or frequency of indels at off-target sequences within the genome of the target cell type. In some embodiments, efficacious guide RNAs are provided which produce indels at off-target sites at very low frequencies (e.g., <5%) in a cell population and/or relative to the frequency of indel creation at the target site. Thus, the disclosure provides for guide RNAs which do not exhibit off-target indel formation in the target cell type (e.g., a hepatocyte such as PHH), or which produce a frequency of off-target indel formation of <5% in a cell population and/or relative to the frequency of indel creation at the target site. In some embodiments, the disclosure provides guide RNAs which do not exhibit any off-target indel formation in the target cell type (e.g., hepatocyte). In some embodiments, guide RNAs are provided which produce indels at less than 5 off-target sites, e.g., as evaluated by one or more methods described herein. In some embodiments, guide RNAs are provided which produce indels at less than or equal to 4, 3, 2, or 1 off-target site(s) e.g., as evaluated by one or more methods described herein. In some embodiments, the off-target site(s) does not occur in a protein coding region in the target cell (e.g., hepatocyte) genome.

In some embodiments, linear amplification is used to detect gene editing events, such as the formation of insertion/deletion ("indel") mutations, translocations, and homology directed repair (HDR) events in target DNA. For example, linear amplification with a unique sequence-tagged primer and isolating the tagged amplification products (herein after referred to as "UnIT," or "Unique Identifier Tagmentation" method) may be used.

In some embodiments, the efficacy of a guide RNA is determined by measuring levels of KLKB1, pKal, total KLKB1 (prekallikrein+pKal), KLKB1 activity, HMWK, HMWK activity, and/or bradykinin, in a sample such as a body fluid, e.g., serum, plasma, or blood.

In some embodiments, the efficacy of a guide RNA is determined by measuring KLKB1 mRNA levels. A decrease in KLKB1 mRNA levels is indicative of an effective guide RNA.

In some embodiments, the efficacy of a guide RNA is determined by measuring levels of bradykinin in a sample such as a body fluid, e.g., serum, plasma, or blood.

In some embodiments, the efficacy of a guide RNA is determined by measuring levels of bradykinin and/or its degradation products in a sample. In some embodiments, the efficacy of a guide RNA is determined by measuring levels of bradykinin and/or its degradation products in the serum or plasma. A decrease in the levels of bradykinin and/or its degradation products in the serum or plasma is indicative of an effective guide RNA.

One method to detect bradykinin in circulating blood is provided in Ferreira, et al., Br. J. Pharmac. Chemother. (1967), 29, 367-377. Bradykinin may also be detected by an enzyme-linked immunosorbent assay (ELISA) assay with cell culture media or serum or plasma. (See, e.g., Abcam Cat. No. ab136936; Markit-M Bradykinin (Gentaur)). In some embodiments, levels of bradykinin are measured in the same in vitro or in vivo systems or models used to measure editing. In some embodiments, levels of bradykinin are measured in cells, e.g., primary human hepatocytes. In some embodiments, levels of bradykinin are measured in a fluid such as serum or plasma. In some embodiments circulating levels of bradykinin are measured.

In some embodiments, the efficacy of a guide RNA is determined by measuring levels of total kallikrein (prekallikrein and plasma kallikrein (pKal)) in a sample. In some embodiments, the efficacy of a guide RNA is determined by measuring levels of total kallikrein in a sample such as a body fluid, e.g., serum, plasma, or blood. In some embodiments, the efficacy of a guide RNA is determined by measuring levels of total kallikrein in the serum or plasma. A decrease in the levels of total kallikrein in the serum or plasma is indicative of an effective guide RNA. In some embodiments, serum and/or plasma total kallikrein is decreased below 40% of basal levels. In some embodiments, levels of total kallikrein are measured using an enzyme-linked immunosorbent assay (ELISA) assay with cell culture media or serum or plasma. In some embodiments, levels of total kallikrein are measured in the same in vitro or in vivo systems or models used to measure editing. In some embodiments, levels of total kallikrein are measured in cells, e.g., primary human hepatocytes. In some embodiments, levels of total kallikrein are measured in PHH and PCH cells.

In some embodiments, the efficacy of a guide RNA is determined by measuring levels of prekallikrein and/or kallikrein in a sample such as a body fluid, e.g., serum, plasma, or blood. In some embodiments, the efficacy of a guide RNA is determined by measuring levels of prekallikrein and/or kallikrein in the serum or plasma. A decrease in the levels of prekallikrein and/or kallikrein in the serum or plasma is indicative of an effective guide RNA. In some embodiments, levels of prekallikrein and/or kallikrein are measured using an enzyme-linked immunosorbent assay (ELISA) assay with cell culture media or serum or plasma. In some embodiments, levels of prekallikrein and/or kallikrein are measured in the in vitro or in vivo systems or models used to measure editing. In some embodiments, levels of prekallikrein and/or kallikrein are measured in cells, e.g., primary human hepatocytes, in plasma, or in cell culture media. In some embodiments, levels of prekallikrein and/or kallikrein are measured from a plasma sample. In some embodiments, levels of prekallikrein and/or kallikrein are measured from a serum sample. Prekallikrein and/or pKal protein levels are optionally measured by ELISA after an activation step to convert prekallikrein to its active form, pKal.

In some embodiments, the efficacy of a guide RNA is determined by measuring levels of prekallikrein in a sample. In some embodiments, the efficacy of a guide RNA is determined by measuring levels of prekallikrein in a sample such as a body fluid, e.g., serum, plasma, or blood. In some embodiments, the efficacy of a guide RNA is determined by measuring levels of prekallikrein in the serum or plasma. A decrease in the levels of prekallikrein in the serum or plasma is indicative of an effective guide RNA. In some embodiments, serum and/or plasma prekallikrein is reduced at least 60%, 70%, 80%, 85%, 90%, 95% or more. In some embodiments, serum and/or plasma total kallikrein, prekallikrein and/or kallikrein is decreased by about 60-80%, 60-90%, 60-95%, 60-100%, 85-95%, or 85-100%. In some embodiments, levels of prekallikrein are measured using an enzyme-linked immunosorbent assay (ELISA) assay with cell culture media or serum or plasma. In some embodiments, levels of prekallikrein are measured in the in vitro or in vivo systems or models used to measure editing. In some embodiments, levels of prekallikrein are measured in cells, e.g., primary human hepatocytes, in plasma, or in cell culture media. In some embodiments, levels of prekallikrein are measured from a plasma sample. In some embodiments, levels of prekallikrein are measured from a serum sample.

In some embodiments, the efficacy of a guide RNA is determined by measuring levels of pKal in a sample. In some embodiments, the efficacy of a guide RNA is determined by measuring levels of pKal in the serum or plasma. A decrease in the level of pKal in the serum or plasma is indicative of an effective guide RNA. In some embodiments, level of pKal is reduced at least 60%, 70%, 80%, 85%, 90%, 95% or more. In some embodiments, serum and/or plasma pKal is decreased by about 60-80%, 60-90%, 60-95%, 60-100%, 85-95%, or 85-100%. In some embodiments, levels of pKal are measured using an enzyme-linked immunosorbent assay (ELISA) assay with cell culture media or serum or plasma. In some embodiments, levels of pKal are measured in the in vitro or in vivo systems or models used to measure editing. In some embodiments, levels of pKal are measured in cells, e.g., primary human hepatocytes, in plasma, or in cell culture media. In some embodiments, levels of pKal are measured from a plasma sample. In some embodiments, levels of pKal are measured from a serum sample.

In some embodiments, the efficacy of a guide RNA is determined by measuring levels of circulating cleaved HMWK (cHMWK) and total HMWK in citrated serum or citrated plasma. In some embodiments, the efficacy of a guide RNA is determined by measuring levels of circulating cleaved HMWK (cHMWK) and total HMWK in the serum or plasma. A decrease in the proportion of cleaved HMWK compared to total HMWK is indicative of an effective guide RNA. In some embodiments, the proportion of cleaved HMWK compared to total HMWK can target a ratio of circulating plasma cHMWK to total HMWK of less than about 60%. In some embodiments the ratio of cHMWK to HMWK is less than about 10%, 15%, 20%, 25%, 30%, 35%, 40%, 50%, or more. In some embodiments, levels of prekallikrein are measured using western Blotting assay with cell culture media or serum or plasma. In some embodiments, levels of cHMWK and total HMWK are measured in the in vitro or in vivo systems or models used to measure editing. In some embodiments, levels of cHMWK and total HMWK are measured in cells, e.g., primary human hepatocytes, in plasma, or in cell culture media. In some embodiments, levels of cHMWK and total HMWK are measured from a plasma sample. In some embodiments, levels of cHMWK and total HMWK are measured from a serum sample.

In some embodiments, the efficacy of a guide RNA is determined by measuring pKal activity in a sample. A decrease in the pKal activity is indicative of an effective guide RNA. In some embodiments, the efficacy of a guide RNA is determined by measuring pKal activity in the serum or plasma.

In some embodiments, the pKal activity is measured as the capacity of a citrated serum sample or citrated plasma sample to convert HMWK to cHMWK (See Banerji et al, N Engl J Med 2017; 376:717-28.). A decrease in the final proportion of cHMWK to total HMWK indicates a decrease in pKal activity. The levels of cHMWK and full length HMWK can be measured by western blotting. In other embodiments, pKal activity is measured as the capacity of a citrated serum sample or citrated plasma sample to enzymatically cleave a HWMK-like peptide substrate, in which case a decrease in substrate cleavage indicates a decrease in pKal activity.

In some embodiments, the pKal activity is reduced by at least 40%, 50%, 60%, 70%, 80%, 85%, 90%, 95% or more. In some embodiments, the pKal activity is decreased by about 60-80%, 60-90%, 60-95%, 60-100%, 85-95%, or 85-100%. In some embodiments, pKal activity is reduced to less than about 40% of basal levels. In some embodiments, pKal activity is reduced to about 40-50% of basal levels. In some embodiments, pKal activity is reduced to 20-40 or 20-50% of basal levels. In some embodiments, levels of pKal activity are measured in the in vitro or in vivo systems or models used to measure editing. In some embodiments, levels of pKal activity are measured in cells, e.g., primary human hepatocytes, in plasma, or in cell culture media. In some embodiments, levels of pKal activity are measured from a plasma sample. In some embodiments, levels of pKal are measured from a serum sample.

III. Therapeutic Methods

The gRNAs and associated methods and compositions disclosed herein are useful in treating and preventing HAE and preventing symptoms of HAE. In some embodiments, the gRNAs and associated methods and compositions are useful for reducing the frequency of HAE attacks. In some embodiments, the gRNAs and associated methods and compositions are useful for preventing HAE attacks. In some embodiments, the gRNAs disclosed herein are useful in treating and preventing bradykinin production and accumulation, bradykinin-induced swelling, angioedema obstruction of the airway, or asphyxiation. In some embodiments, the gRNAs disclosed herein are useful in treating or preventing angioedema and attacks caused by HAE. In some embodiments, the gRNAs disclosed herein are useful for reducing the frequency of angioedema attacks, such as HAE attacks. In some embodiments, the gRNAs disclosed herein are useful for reducing the severity of angioedema attacks. In some embodiments, the gRNAs disclosed herein are useful for reducing the frequency and/or severity of attacks, such as HAE attacks. In some embodiments, the gRNAs disclosed herein are useful for achieving remission of angioedema attacks, such as HAE attacks. In some embodiments, the gRNAs disclosed herein are useful for achieving durable remission, e.g. maintained for at least 1 month, 2 months, 4 months, 6 months, 1 year, 2 years, 5 years, 10 years or more.

The gRNAs and associated methods and compositions disclosed herein are useful to decrease KLKB1 mRNA production. Therefore, in one aspect, effectiveness of treatment/prevention can be assessed by measuring KLKB1 mRNA levels, wherein a decrease in KLKB1 mRNA levels indicates effectiveness.

The gRNAs and associated methods and compositions disclosed herein are useful to decrease prekallikrein protein levels in plasma or serum. Therefore, in one aspect, effectiveness of treatment/prevention can be assessed by measuring prekallikrein protein levels or total kallikrein protein levels, wherein a decrease in prekallikrein and/or kallikrein protein indicates effectiveness. In some embodiments, effectiveness of treatment/prevention can be assessed by measuring prekallikrein protein in a sample, such as serum or plasma, wherein a decrease in prekallikrein indicates effectiveness. For example, plasma or serum prekallikrein can be measured by ELISA as described in Ferrone J D, Bhattacharjee G, Revenko A S, et al. IONIS-$PKK_{Rx}$ a Novel Antisense Inhibitor of Prekallikrein and Bradykinin Production. *Nucleic Acid Ther.* 2019; 29(2):82-91. Similarly, kallikrein can be measured by ELISA as described herein, and administration of the gRNAs disclosed herein can decrease kallikrein protein levels in plasma or serum.

The gRNAs and associated methods and compositions disclosed herein are useful to decrease total kallikrein (prekallikrein and pKal) protein levels in plasma or serum. Therefore, in one aspect, effectiveness of treatment/prevention can be assessed by measuring total kallikrein (prekallikrein and pKal) protein levels, wherein a decrease in total kallikrein protein indicates effectiveness. Total kallikrein, prekallikrein, and/or kallikrein may be measured before or after activation to release plasma kallikrein. In some embodiments, effectiveness of treatment/prevention can be assessed by measuring prekallikrein and/or pKal protein in a sample, such as serum or plasma, wherein a decrease in prekallikrein protein indicates effectiveness. In some embodiments, effectiveness of treatment/prevention can be assessed by measuring pKal protein in a sample, such as serum or plasma, wherein a decrease in pKal protein indicates effectiveness. For example, levels of prekallikrein and pKal protein can be measured by ELISA, for example by using the Prekallikrein and Kallikrein Human ELISA Kit (Abcam, Eugene, OR). Prekallikrein and/or pKal protein levels are optionally measured by ELISA after an activation step to convert prekallikrein to its active form, pKal.

The gRNAs and associated methods and compositions disclosed herein are useful to decrease the proportion of circulating cleaved HMWK (cHMWK) compared to total HMWK in citrated serum or citrated plasma. Therefore, in one aspect, effectiveness of treatment/prevention can be assessed by measuring total HMWK and cHMWK protein levels, wherein a decrease in the proportion of cleaved HMWK indicates effectiveness. In some embodiments, effectiveness of treatment/prevention can be assessed by measuring total HMWK and cHMWK protein levels in a sample, such as serum or plasma, wherein a decrease in the proportion of cHMWK indicates effectiveness. For example, the proportion of cHMWK compared to total HMWK in citrated serum or citrated plasma samples can be measured by western blotting as described in Suffritti C, Zanichelli A, Maggioni L, Bonanni E, Cugno M, Cicardi M. High-molecular weight kininogen cleavage correlates with disease states in the bradykinin-mediated angioedema due to hereditary C1-inhibitor deficiency. Clin Exp Allergy 2014; 44:1503-14 and in Banerji A, Busse P, Shennak M, et al. Inhibiting plasma kallikrein for hereditary angioedema prophylaxis. N Engl J Med 2017; 376:717-28.

Circulating plasma cHMWK levels below about 30% total HMWK were associated with decreases in HAE attacks in patients treated with lanadelumab (See Banerji, et al, 2017). In this same study, healthy controls had plasma levels of cHMWK around 8.3% total HMWK. In another study, Suffriti and colleagues found cHMWK plasma levels of an average of about 34.8% in normal controls, about 41.4% in HAE patients in remission and about 58.1% in HAE patients during an attack (Suffritti, et al. Clin Exp Allergy 2014; 44:1503-14). Accordingly, in some embodiments, the gRNAs and associated methods and compositions disclosed herein are useful for reducing circulating cHMWK levels such that a subject exhibits reduced number of HAE attacks. In some embodiments, the gRNAs and associated methods and compositions disclosed herein are useful to reduce a subject's proportion of cHMWK in citrated plasma to below 30%. In some embodiments, the gRNAs and associated methods and compositions disclosed herein are useful to reduce a subject's proportion of cHMWK in citrated plasma to below 30%, 20%, and/or 10%. In some embodiments, the gRNAs and associated methods and compositions disclosed herein are useful to reduce a subject's proportion of cHMWK in citrated plasma to about those of healthy controls.

The gRNAs and associated methods and compositions disclosed herein can be useful to decrease the spontaneous pKal activity in serum or plasma. Therefore, in one aspect, effectiveness of treatment/prevention can be assessed by measuring spontaneous pKal activity, wherein a decrease in spontaneous pKal activity indicates effectiveness. In some embodiments, effectiveness of treatment/prevention can be assessed by measuring spontaneous pKal activity in a sample, such as serum or plasma, wherein a decrease in spontaneous pKal activity indicates effectiveness. In certain embodiments, the gRNAs and associated methods and compositions disclosed herein are useful to decrease the basal level of circulating pKal and circulating pKal activity.

The gRNAs and associated methods and compositions disclosed herein can be useful to decrease the inducible pKal activity in serum or plasma. Therefore, in one aspect, effectiveness of treatment/prevention can be assessed by measuring inducible pKal activity, wherein a decrease in inducible pKal activity indicates effectiveness. In some embodiments, effectiveness of treatment/prevention can be assessed by measuring inducible pKal activity in a sample, such as serum or plasma, wherein a decrease in inducible pKal activity indicates effectiveness. In some examples, pKal activity can be induced by exposure of a sample to FXIIa (See Banerji et al, N Engl J Med 2017; 376:717-28.) In some examples, pKal activity can be induced by incubation of a sample with dextran sulfate (See Ferrone, et al. *Nucleic Acid Ther.* 2019; 29(2):82-91.) In some examples pKal activity can be induced by addition of ellagic acid to a sample (Aygören-Pürsün, et al. J Allergy Clin Immunol 2016; 138: 934-936.)

In some examples, pKal activity is measured as the capacity of a citrated serum sample or citrated plasma sample to convert HMWK to cHMWK (See Banerji et al, N Engl J Med 2017; 376:717-28.) wherein a decrease in the final proportion of cHMWK to total HMWK indicates a decrease in pKal activity. The proportion of cHMWK and full length HMWK can be measured by Western blotting, for instance as described by Suffritti, et al. Clin Exp Allergy 2014; 44:1503-14. In other examples, pKal activity is measured as the capacity of a citrated serum sample or citrated plasma sample to enzymatically cleave a HWMK-like peptide substrate, in which case a decrease in substrate cleavage indicates a decrease in pKal activity. In one example, the substrate peptide can be the chromogenic substrate H-D-Pro-Phe-Arg-p-nitroanilide peptide (Bachem, Cat. L-2120) and cleavage can be measured as change in A405 (See Defendi et al, PLoS One 2013; 8:e70140). In another example the substrate peptide can be the fluorogenic substrate H-Pro-Phe-Arg-AMC (Sigma, Cat No. P9273) and cleavage can be measured as fluorescence changes as excitation and emission wavelengths at 360 and 480 nm, respectively (See Banerji, et al., *N Engl J Med* 2017; 376:717-28).

In one study, reduction of induced pKal activity by more than 40% was associated with a reduction in HAE attacks (Banerji, et al., *N Engl J Med* 2017; 376:717-28). Reduction of induced pKal activity by at least 50% was associated with a reduction in HAE attacks with treatment by BCX7353 (Aygören-Pürsün, et al., *N Engl J Med* 2018; 379:352-362). Reductions of induced pKal activity by 60% have been associated with reduction in attacks in treatment with lanadelumab (Banerji, et al., *N Engl J Med* 2017; 376:717-28). Accordingly, in some embodiments, administration of the gRNAs and compositions disclosed herein are useful for reducing kallikrein activity, e.g. total kallikrein, prekallikrein, and/or pKal activity) such that a subject exhibits fewer HAE attacks.

In some embodiments, administration of the gRNAs and compositions disclosed herein reduces a subject's pKal activity to less than about 40% of basal levels. In some embodiments, administration of the gRNAs and compositions disclosed herein reduces a subject's pKal activity to about 40-50% of basal levels. In some embodiments, administration of the gRNAs and compositions disclosed herein reduces a subject's pKal activity to 20-40% or 20-50% of basal levels.

In some embodiments, any one or more of the gRNAs, compositions, or pharmaceutical formulations described herein is for use in preparing a medicament for treating or preventing a disease or disorder in a subject. In some embodiments, treatment and/or prevention is accomplished with a single dose, e.g., one-time treatment, of medicament/composition. In some embodiments, the disease or disorder is HAE.

In some embodiments, the invention comprises a method of treating or preventing a disease or disorder in a subject comprising administering any one or more of the gRNAs, compositions, or pharmaceutical formulations described herein. In some embodiments, the disease or disorder is HAE. In some embodiments, the gRNAs, compositions, or pharmaceutical formulations described herein are administered as a single dose, e.g., at one time. In some embodiments, the single dose achieves durable treatment and/or prevention. In some embodiments, the method achieves durable treatment and/or prevention. Durable treatment and/or prevention, as used herein, includes treatment and/or prevention that extends at least i) 3, 4, 5, 6, 7, 8, 9, 10, 11, 12, 13, 14, or 15 weeks; ii) 1, 2, 3, 4, 5, 6, 7, 8, 9, 10, 11, 12, 18, 24, 30, or 36 months; or iii) 1, 2, 3, 4, 5, 6, 7, 8, 9, or 10 years. In some embodiments, a single dose of the gRNAs, compositions, or pharmaceutical formulations described herein is sufficient to treat and/or prevent any of the indications described herein for the duration of the subject's life.

In some embodiments, the invention comprises a method or use of modifying (e.g., creating a double strand break) a target DNA comprising, administering or delivering any one or more of the gRNAs, compositions, or pharmaceutical formulations described herein. In some embodiments, the target DNA is the KLKB1 gene. In some embodiments, the target DNA is in an exon of the KLKB1 gene. In some embodiments, the target DNA is in exon 1, 2, 3, 4, 5, 6, 7, 8, 9, 10, 11, 12, 13, 14, or 15 of the KLKB1 gene.

In some embodiments, the invention comprises a method or use for modulation of a target gene comprising, administering or delivering any one or more of the gRNAs, compositions, or pharmaceutical formulations described herein. In some embodiments, the modulation is editing of the KLKB1 target gene. In some embodiments, the modulation is a change in expression of the protein encoded by the KLKB1 target gene.

In some embodiments, the method or use results in gene editing. In some embodiments, the method or use results in a double-stranded break within the target KLKB1 gene. In some embodiments, the method or use results in formation of indel mutations during non-homologous end joining of the DSB. In some embodiments, the method or use results in an insertion or deletion of nucleotides in a target KLKB1 gene. In some embodiments, the insertion or deletion of nucleotides in a target KLKB1 gene leads to a frameshift mutation or premature stop codon that results in a non-functional protein. In some embodiments, the insertion or deletion of nucleotides in a target KLKB1 gene leads to a knockdown or elimination of target gene expression.

In some embodiments, the method or use results in KLKB1 gene modulation. In some embodiments, the KLKB1 gene modulation is a decrease in gene expression. In some embodiments, the method or use results in decreased expression of the protein encoded by the target gene in a population of cells or in vivo.

In some embodiments, a method of inducing a double-stranded break (DSB) within the KLKB1 gene is provided comprising administering a composition comprising a guide RNA comprising any one or more guide sequences of SEQ ID NOs: 1-149. In some embodiments, gRNAs comprising any one or more of the guide sequences of SEQ ID NOs: 1-149 are administered to induce a DSB in the KLKB1 gene. The guide RNAs may be administered together with an RNA-guided DNA nuclease such as a Cas nuclease (e.g., Cas9) or an mRNA or vector encoding an RNA-guided DNA nuclease such as a Cas nuclease (e.g., Cas9).

In some embodiments, a method of modifying the KLKB1 gene is provided comprising administering a composition comprising a guide RNA comprising any one or more of the guide sequences of SEQ ID NOs: 1-149. In some embodiments, gRNAs comprising any one or more of the guide sequences of SEQ ID NOs: 1-149 are administered to modify the KLKB1 gene. The guide RNAs may be administered together with an RNA-guided DNA nuclease such as a Cas nuclease (e.g., Cas9) or an mRNA or vector encoding an RNA-guided DNA nuclease such as a Cas nuclease (e.g., Cas9).

In some embodiments, a method of treating or preventing hereditary angioedema (HAE) is provided comprising administering a composition comprising a guide RNA comprising any one or more of the guide sequences of SEQ ID NOs: 1-149. In some embodiments, gRNAs comprising any one or more of the guide sequences of SEQ ID NOs: 1-149 are administered to treat or prevent HAE. The guide RNAs may be administered together with an RNA-guided DNA nuclease such as a Cas nuclease (e.g., Cas9) or an mRNA or vector encoding an RNA-guided DNA nuclease such as a Cas nuclease (e.g., Cas9).

In some embodiments, a method of decreasing or eliminating bradykinin production and accumulation is provided comprising administering a guide RNA comprising any one or more of the guide sequences of SEQ ID NOs: 1-149. The guide RNAs may be administered together with an RNA-guided DNA nuclease such as a Cas nuclease (e.g., Cas9) or an mRNA or vector encoding an RNA-guided DNA nuclease such as a Cas nuclease (e.g., Cas9).

In some embodiments, a method of treating or preventing bradykinin-induced swelling is provided comprising administering a guide RNA comprising any one or more of the guide sequences of SEQ ID NOs: 1-149. The guide RNAs may be administered together with an RNA-guided DNA nuclease such as a Cas nuclease (e.g., Cas9) or an mRNA or vector encoding an RNA-guided DNA nuclease such as a Cas nuclease (e.g., Cas9).

In some embodiments, a method of treating or preventing bradykinin-induced angioedema is provided comprising administering a guide RNA comprising any one or more of the guide sequences of SEQ ID NOs: 1-149. The guide RNAs may be administered together with an RNA-guided DNA nuclease such as a Cas nuclease (e.g., Cas9) or an mRNA or vector encoding an RNA-guided DNA nuclease such as a Cas nuclease (e.g., Cas9).

In some embodiments, a method of treating or preventing obstruction of the airway and/or asphyxiation is provided comprising administering a guide RNA comprising any one or more of the guide sequences of SEQ ID NOs: 1-149. The guide RNAs may be administered together with an RNA-guided DNA nuclease such as a Cas nuclease (e.g., Cas9) or an mRNA or vector encoding an RNA-guided DNA nuclease such as a Cas nuclease (e.g., Cas9).

In some embodiments, gRNAs comprising any one or more of the guide sequences of SEQ ID NOs: 1-149 are administered to reduce bradykinin levels in the plasma, serum, or blood. The gRNAs may be administered together with an RNA-guided DNA nuclease such as a Cas nuclease (e.g., Cas9) or an mRNA or vector encoding an RNA-guided DNA nuclease such as a Cas nuclease (e.g., Cas9).

In some embodiments, gRNAs comprising any one or more of the guide sequences of SEQ ID NOs: 1-149 are administered to decrease bradykinin in the serum or plasma. The gRNAs may be administered together with an RNA-guided DNA nuclease such as a Cas nuclease (e.g., Cas9) or an mRNA or vector encoding an RNA-guided DNA nuclease such as a Cas nuclease (e.g., Cas9).

In some embodiments, the gRNAs comprising the guide sequences of Table 1 together with an RNA-guided DNA nuclease such as a Cas nuclease induce DSBs, and non-homologous ending joining (NHEJ) during repair leads to a mutation in the KLKB1 gene. In some embodiments, NHEJ leads to a deletion or insertion of a nucleotide(s), which induces a frame shift or nonsense mutation in the KLKB1 gene.

In some embodiments, administering the guide RNAs of the invention (e.g., in a composition provided herein) decrease levels (e.g., serum or plasma levels) of total kallikrein, prekallikrein, and/or kallikrein in the subject, and therefore prevents bradykinin overproduction and accumulation. In some embodiments, administering the guide RNAs of the invention (e.g., in a composition provided herein) decrease kallikrein activity levels (e.g., serum or plasma levels) in the subject, and therefore prevents bradykinin overproduction and accumulation.

In some embodiments, the methods provided herein result in fewer attacks that include fluid leakage through blood cells to tissues. In some embodiments, the methods provided herein reduce the frequency of attacks that increase swelling in organ tissues. In some embodiments, administering the guide RNAs of the invention (e.g., in a composition provided herein) decrease the frequency or severity of angioedema attacks.

In some embodiments, the subject is mammalian. In some embodiments, the subject is a primate, e.g. human.

In some embodiments, the use of a guide RNAs comprising any one or more of the guide sequences in Table 1 or Table 2 (e.g., in a composition provided herein) is provided for the preparation of a medicament for treating a human subject having HAE.

In some embodiments, the guide RNAs, compositions, and formulations are administered intravenously. In some embodiments, the guide RNAs, compositions, and formulations are administered by infusion. In some embodiments, the guide RNAs, compositions, and formulations are administered into the hepatic circulation.

In some embodiments, a single administration of a composition comprising a guide RNA provided herein is sufficient to knock down expression of the protein. In other embodiments, more than one administration of a composition comprising a guide RNA provided herein may be beneficial to maximize therapeutic effects.

In some embodiments, treatment slows or halts HAE disease progression.

In some embodiments, treatment slows or halts progression of angioedema. In some embodiments, treatment results in improvement, stabilization, or slowing of change in symptoms of HAE.

A. Delivery of gRNA Compositions

Lipid nanoparticles (LNPs) are a well-known means for delivery of nucleotide and protein cargo and may be used for delivery of the guide RNAs, compositions, or pharmaceutical formulations disclosed herein. In some embodiments, the LNPs deliver nucleic acid, protein, or nucleic acid together with protein.

In some embodiments, the invention comprises a method for delivering any one of the gRNAs disclosed herein to a subject, wherein the gRNA is associated with an LNP. In some embodiments, the gRNA/LNP is also associated with a Cas9 or an mRNA encoding Cas9.

In some embodiments, the invention comprises a composition comprising any one of the gRNAs disclosed and an LNP. In some embodiments, the composition further comprises a Cas9 or an mRNA encoding Cas9.

In some embodiments, the LNPs comprise cationic lipids. In some embodiments, the LNPs comprise (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate) or another ionizable lipid. See, e.g., lipids of WO 2017/173054 and references described therein. In some embodiments, the LNPs comprise molar ratios of a cationic lipid amine to RNA phosphate (N:P) of about 4.5, 5.0, 5.5, 6.0, or 6.5. In some embodiments, the terms cationic and ionizable in the context of LNP lipids are interchangeable, e.g., wherein ionizable lipids are cationic depending on the pH.

In some embodiments, LNPs associated with the gRNAs disclosed herein are for use in preparing a medicament for treating a disease or disorder.

Electroporation is a well-known means for delivery of cargo, and any electroporation methodology may be used for delivery of any one of the gRNAs disclosed herein. In some embodiments, electroporation may be used to deliver any one of the gRNAs disclosed herein and Cas9 or an mRNA encoding Cas9.

In some embodiments, the invention comprises a method for delivering any one of the gRNAs disclosed herein to an ex vivo cell, wherein the gRNA is associated with an LNP or not associated with an LNP. In some embodiments, the gRNA/LNP or gRNA is also associated with a Cas9 or an mRNA encoding Cas9.

In some embodiments, the guide RNA compositions described herein, alone or encoded on one or more vectors, are formulated in or administered via a lipid nanoparticle; see e.g., WO 2017/173054 and WO 2019/067992, the contents of which are hereby incorporated by reference in their entirety.

In certain embodiments, the invention comprises DNA or RNA vectors encoding any of the guide RNAs comprising any one or more of the guide sequences described herein. In some embodiments, in addition to guide RNA sequences, the vectors further comprise nucleic acids that do not encode guide RNAs. Nucleic acids that do not encode guide RNA include, but are not limited to, promoters, enhancers, regulatory sequences, and nucleic acids encoding an RNA-guided DNA nuclease, which can be a nuclease such as Cas9. In some embodiments, the vector comprises one or more nucleotide sequence(s) encoding a crRNA, a trRNA, or a crRNA and trRNA. In some embodiments, the vector comprises one or more nucleotide sequence(s) encoding an sgRNA and an mRNA encoding an RNA-guided DNA nuclease, which can be a Cas nuclease, such as Cas9 or Cpf1. In some embodiments, the vector comprises one or more nucleotide sequence(s) encoding a crRNA, a trRNA, and an mRNA encoding an RNA-guided DNA nuclease, which can be a Cas protein, such as, Cas9. In one embodiment, the Cas9 is from *Streptococcus pyogenes* (i.e., Spy Cas9). In some embodiments, the nucleotide sequence encoding the crRNA, trRNA, or crRNA and trRNA (which may be an sgRNA) comprises or consists of a guide sequence flanked by all or a portion of a repeat sequence from a naturally-occurring CRISPR/Cas system. The nucleic acid comprising or consisting of the crRNA, trRNA, or crRNA and trRNA may further comprise a vector sequence wherein the vector sequence comprises or consists of nucleic acids that are not naturally found together with the crRNA, trRNA, or crRNA and trRNA.

This description and exemplary embodiments should not be taken as limiting. For the purposes of this specification and appended claims, unless otherwise indicated, all numbers expressing quantities, percentages, or proportions, and other numerical values used in the specification and claims, are to be understood as being modified in all instances by the term "about," to the extent they are not already so modified. Accordingly, unless indicated to the contrary, the numerical parameters set forth in the following specification and attached claims are approximations that may vary depending upon the desired properties sought to be obtained. At the very least, and not as an attempt to limit the application of the doctrine of equivalents to the scope of the claims, each numerical parameter should at least be construed in light of the number of reported significant digits and by applying ordinary rounding techniques.

It is noted that, as used in this specification and the appended claims, the singular forms "a," "an," and "the," and any singular use of any word, include plural referents unless expressly and unequivocally limited to one referent. As used herein, the term "include" and its grammatical variants are intended to be non-limiting, such that recitation of items in a list is not to the exclusion of other like items that can be substituted or added to the listed items.

EXAMPLES

The following examples are provided to illustrate certain disclosed embodiments and are not to be construed as limiting the scope of this disclosure in any way.

Example 1: Materials and Methods

1.1 In Vitro Transcription ("IVT") of Nuclease mRNA

Capped and polyadenylated *Streptococcus pyogenes* ("Spy") Cas9 mRNA containing N1-methyl pseudo-U was generated by in vitro transcription using a linearized plasmid DNA template and T7 RNA polymerase. Plasmid DNA containing a T7 promoter and a sequence for transcription (for producing mRNA comprising an mRNA described herein (see SEQ ID NOs: 501-516 in Table 5 below for Cas9 ORFs)) was linearized by incubating at 37° C. to complete digestion with XbaI with the following conditions: 200 ng/μL plasmid, 2 U/μL XbaI (NEB), and 1× reaction buffer. The XbaI was inactivated by heating the reaction at 65° C. for 20 min. The linearized plasmid was purified from enzyme and buffer salts using a silica maxi spin column (Epoch Life Sciences) and analyzed by agarose gel to confirm linearization. The IVT reaction to generate Cas9 mRNA was incubated at 37° C. for 4 hours in the following conditions: 50 ng/μL linearized plasmid; 2 mM each of GTP, ATP, CTP, and N1-methyl pseudo-UTP (Trilink); 10 mM ARCA (Trilink); 5 U/μL T7 RNA polymerase (NEB); 1 U/μL Murine RNase inhibitor (NEB); 0.004 U/μL Inorganic *E. coli* pyrophosphatase (NEB); and 1× reaction buffer. After the 4-hour incubation, TURBO DNase (ThermoFisher) was added to a final concentration of 0.01 U/μL, and the reaction was incubated for an additional 30 minutes to remove the DNA template. The Cas9 mRNA was purified from enzyme and nucleotides using a MegaClear Transcription Clean-up kit according to the manufacturer's protocol (ThermoFisher). Alternatively, the Cas9 mRNA was purified with a LiCl precipitation method, which in some cases was followed by further purification by tangential flow filtration. The transcript concentration was determined by measuring the light absorbance at 260 nm (Nanodrop®), and the transcript was analyzed by capillary electrophoresis by Bioanlayzer® (Agilent).

TABLE 5

Exemplary Cas9 mRNA Sequences

| SEQ ID NO | Sequence |
| --- | --- |
| 501 | GGGTCCCGCAGTCGGCGTCCAGCGGCTCTGCTTGTTCGTGTGTGTGTCGTTGCAGGCCTTATTCGGATCCGCCACCATGGAC AAGAAGTACAGCATCGGACTGGACATCGGAACAAACAGCGTCGGATGGGCAGTCATCACAGACGAATACAAGGTCCCGAG CAAGAAGTTCAAGGTCCTGGGAAACACAGACAGACACAGCATCAAGAAGAACCTGATCGGAGCACTGCTGTTCGACAGCG GAGAAACAGCAGAAGCAACAAGACTGAAGAGAACAGCAAGAAGAAGATACACAAGAAGAAAGAACAGAATCTGCTACCT GCAGGAAATCTTCAGCAACGAAATGGCAAAGGTCGACGACAGCTTCTTCCACAGACTGGAAGAAAGCTTCCTGGTCGAAG |

TABLE 5-continued

| Exemplary Cas9 mRNA Sequences | |
|---|---|
| SEQ ID NO | Sequence |
| | AAGACAAGAAGCACGAAAGACACCCGATCTTCGGAAACATCGTCGACGAAGTCGCATACCACGAAAAGTACCCGACAATC<br>TACCACCTGAGAAAGAAGCTGGTCGACAGCACAGACAAGGCAGACCTGAGACTGATCTACCTGGCACTGGCACACATGAT<br>CAAGTTCAGAGGACACTTCCTGATCGAAGGAGACCTGAACCCGGACAACAGCGACGTCGACAAGCTGTTCATCCAGCTGG<br>TCCAGACATACAACCAGCTGTTCGAAGAAAACCCGATCAACGCAAGCGGAGTCGACGCAAAGGCAATCCTGAGCGCAAGA<br>CTGAGCAAGAGCAGAAGACTGGAAAACCTGATCGCACAGCTGCCGGGAGAAAAGAAGAACGGACTGTTCGGAAACCTGA<br>TCGCACTGAGCCTGGGACTGACACCGAACTTCAAGAGCAACTTCGACCTGGCAGAAGACGCAAAGCTGCAGCTGAGCAAG<br>GACACATACGACGACGACCTGGACAACCTGCTGGCACAGATCGGAGACCAGTACGCAGACCTGTTCCTGGCAGCAAAGAA<br>CCTGAGCGACGCAATCCTGCTGAGCGACATCCTGAGAGTCAACACAGAAATCACAAAGGCACCGCTGAGCGCAAGCATGA<br>TCAAGAGATACGACGAACACCACCAGGACCTGACACTGCTGAAGGCACTGGTCAGACAGCAGCTGCCGGAAAAGTACAAG<br>GAAATCTTCTTCGACCAGAGCAAGAACGGATACGCAGGATACATCGACGGAGGAGCAAGCCAGGAAGAATTCTACAAGTT<br>CATCAAGCCGATCCTGGAAAAGATGGACGGAACAGAAGAACTGCTGGTCAAGCTGAACAGAGAAGACCTGCTGAGAAAG<br>CAGAGAACATTCGACAACGGAAGCATCCCGCACCAGATCCACCTGGGAGAACTGCACGCAATCCTGAGAAGACAGGAAG<br>ACTTCTACCCGTTCCTGAAGGACAACAGAGAAAAGATCGAAAAGATCCTGACATTCAGAATCCCGTACTACGTCGGACCGC<br>TGGCAAGAGGAAACAGCAGATTCGCATGGATGACAAGAAAGAGCGAAGAAACAATCACACCGTGGAACTTCGAAGAAGT<br>CGTCGACAAGGGAGCAAGCGCACAGAGCTTCATCGAAAGAATGACAAACTTCGACAAGAACCTGCCGAACGAAAAGGTCC<br>TGCCGAAGCACAGCCTGCTGTACGAATACTTCACAGTCTACAACGAACTGACAAAGGTCAAGTACGTCACAGAAGGAATG<br>AGAAAGCCGGCATTCCTGAGCGGAGAACAGAAGAAGGCAATCGTCGACCTGCTGTTCAAGACAAACAGAAAGGTCACAGT<br>CAAGCAGCTGAAGGAAGACTACTTCAAGAAGATCGAATGCTTCGACAGCGTCGAAATCAGCGGAGTCGAAGACAGATTCA<br>ACGCAAGCCTGGGAACATACCACGACCTGCTGAAGATCATCAAGGACAAGGACTTCCTGGACAACGAAGAAAACGAAGAC<br>ATCCTGGAAGACATCGTCCTGACACTGACACTGTTCGAAGACAGAGAAATGATCGAAGAAAGACTGAAGACATACGCACA<br>CCTGTTCGACGACAAGGTCATGAAGCAGCTGAAGAGAAGAAGATACACAGGATGGGGAAGACTGAGCAGAAAGCTGATC<br>AACGGAATCAGAGACAAGCAGAGCGGAAAGACAATCCTGGACTTCCTGAAGAGCGACGGATTCGCAAACAGAAACTTCAT<br>GCAGCTGATCCACGACGACAGCCTGACATTCAAGGAAGACATCCAGAAGGCACAGGTCAGCGGACAGGGAGACAGCCTG<br>CACGAACACATCGCAAACCTGGCAGGAAGCCCGGCAATCAAGAAGGGAATCCTGCAGACAGTCAAGGTCGTCGACGAACT<br>GGTCAAGGTCATGGGAAGACACAAGCCGGAAAACATCGTCATCGAAATGGCAAGAGAAAACCAGACAACACAGAAGGGA<br>CAGAAGAACAGCAGAGAAAGAATGAAGAGAATCGAAGAAGGAATCAAGGAACTGGGAAGCCAGATCCTGAAGGAACAC<br>CCGGTCGAAAACACACAGCTGCAGAACGAAAAGCTGTACCTGTACTACCTGCAGAACGGAAGAGACATGTACGTCGACCA<br>GGAACTGGACATCAACAGACTGAGCGACTACGACGTCGACCACATCGTCCCGCAGAGCTTCCTGAAGGACGACAGCATCG<br>ACAACAAGGTCCTGACAAGAAGCGACAAGAACAGAGGAAAGAGCGACAACGTCCCGAGCGAAGAAGTCGTCAAGAAGAT<br>GAAGAACTACTGGAGACAGCTGCTGAACGCAAAGCTGATCACACAGAGAAAGTTCGACAACCTGACAAAGGCAGAGAGA<br>GGAGGACTGAGCGAACTGGACAAGGCAGGATTCATCAAGAGACAGCTGGTCGAAACAAGACAGATCACAAAGCACGTCG<br>CACAGATCCTGGACAGCAGAATGAACACAAAGTACGACGAAAACGACAAGCTGATCAGAGAAGTCAAGGTCATCACACTG<br>AAGAGCAAGCTGGTCAGCGACTTCAGAAAGGACTTCCAGTTCTACAAGGTCAGAGAAATCAACAACTACCACCACGCACA<br>CGACGCATACCTGAACGCAGTCGTCGGAACAGCACTGATCAAGAAGTACCCGAAGCTGGAAAGCGAATTCGTCTACGGAG<br>ACTACAAGGTCTACGACGTCAGAAAGATGATCGCAAAGAGCGAACAGGAAATCGGAAAGGCAACAGCAAAGTACTTCTTC<br>TACAGCAACATCATGAACTTCTTCAAGACAGAAATCACACTGGCAAACGGAGAAATCAGAAAGAGACCGCTGATCGAAAC<br>AAACGGAGAAACAGGAGAAATCGTCTGGGACAAGGGAAGAGACTTCGCAACAGTCAGAAAGGTCCTGAGCATGCCGCAG<br>GTCAACATCGTCAAGAAGACAGAAGTCCAGACAGGAGGATTCAGCAAGGAAAGCATCCTGCCGAAGAGAAACAGCGACA<br>AGCTGATCGCAAGAAAGAAGGACTGGGACCCGAAGAAGTACGGAGGATTCGACAGCCCGACAGTCGCATACAGCGTCCTG<br>GTCGTCGCAAAGGTCGAAAAGGGAAAGAGCAAGAAGCTGAAGAGCGTCAAGGAACTGCTGGGAATCACAATCATGGAAA<br>GAAGCAGCTTCGAAAAGAACCCGATCGACTTCCTGGAAGCAAAGGGATACAAGGAAGTCAAGAAGGACCTGATCATCAAG<br>CTGCCGAAGTACAGCCTGTTCGAACTGGAAAACGGAAGAAAGAGAATGCTGGCAAGCGCAGGAGAACTGCAGAAGGGAA<br>ACGAACTGGCACTGCCGAGCAAGTACGTCAACTTCCTGTACCTGGCAAGCCACTACGAAAAGCTGAAGGGAAGCCCGGAA<br>GACAACGAACAGAAGCAGCTGTTCGTCGAACAGCACAAGCACTACCTGGACGAAATCATCGAACAGATCAGCGAATTCAG<br>CAAGAGAGTCATCCTGGCAGACGCAAACCTGGACAAGGTCCTGAGCGCATACAACAAGCACAGAGACAAGCCGATCAGA<br>GAACAGGCAGAAAACATCATCCACCTGTTCACACTGACAAACCTGGGAGCACCGGCAGCATTCAAGTACTTCGACACAAC<br>AATCGACAGAAAGAGATACACAAGCACAAAGGAAGTCCTGGACGCAACACTGATCCACCAGAGCATCACAGGACTGTACG<br>AAACAAGAATCGACCTGAGCCAGCTGGGAGGAGACGGAGGAGGAAGCCCGAAGAAGAAGAGAAAGGTCTAGCTAGCCAT<br>CACATTTAAAAGCATCTCAGCCTACCATGAGAATAAGAGAAAGAAAATGAAGATCAATAGCTTATTCATCTCTTTTTCTTTT<br>TCGTTGGTGTAAAGCCAACACCCTGTCTAAAAAACATAAATTTCTTTAATCATTTTGCCTCTTTTCTCTGTGCTTCAATTAAT<br>AAAAAATGGAAAGAACCTCGAG |
| 502 | AUGGACAAGAAGUACAGCAUCGGACUGGACAUCGGAACAAACAGCGUCGGAUGGGCAGUCAUCACAGACGAAUACAAG<br>GUCCCGAGCAAGAAGUUCAAGGUCCUGGGAAACACAGACAGACACAGCAUCAAGAAGAACCUGAUCGGAGCACUGCUG<br>UUCGACAGCGGAGAAACAGCAGAAGCAACAAGACUGAAGAGAACAGCAAGAAGAAGAUACACAAGAAGAAAGAACAGA<br>AUCUGCUACCUGCAGGAAAUCUUCAGCAACGAAAUGGCAAAGGUCGACGACAGCUUCUUCCACAGACUGGAAGAAAGC<br>UUCCUGGUCGAAGAAGACAAGAAGCACGAAAGACACCCGAUCUUCGGAAACAUCGUCGACGAAGUCGCAUACCACGAA<br>AAGUACCCGACAAUCUACCACCUGAGAAAGAAGCUGGUCGACAGCACAGACAAGGCAGACCUGAGACUGAUCUACCUG<br>GCACUGGCACACAUGAUCAAGUUCAGAGGACACUUCCUGAUCGAAGGAGACCUGAACCCGGACAACAGCGACGUCGAC<br>AAGCUGUUCAUCCAGCUGGUCCAGACAUACAACCAGCUGUUCGAAGAAAACCCGAUCAACGCAAGCGGAGUCGACGCA<br>AAGGCAAUCCUGAGCGCAAGACUGAGCAAGAGCAGAAGACUGGAAAACCUGAUCGCACAGCUGCCGGGAGAAAAGAAG<br>AACGGACUGUUCGGAAACCUGAUCGCACUGAGCCUGGGACUGACACCGAACUUCAAGAGCAACUUCGACCUGGCAGAA<br>GACGCAAAGCUGCAGCUGAGCAAGGACACAUACGACGACGACCUGGACAACCUGCUGGCACAGAUCGGAGACCAGUAC<br>GCAGACCUGUUCCUGGCAGCAAAGAACCUGAGCGACGCAAUCCUGCUGAGCGACAUCCUGAGAGUCAACACAGAAAUC<br>ACAAAGGCACCGCUGAGCGCAAGCAUGAUCAAGAGAUACGACGAACACCACCAGGACCUGACACUGCUGAAGGCACUG<br>GUCAGACAGCAGCUGCCGGAAAAGUACAAGGAAAUCUUCUUCGACCAGAGCAAGAACGGAUACGCAGGAUACAUCGAC<br>GGAGGAGCAAGCCAGGAAGAAUUCUACAAGUUCAUCAAGCCGAUCCUGGAAAAGAUGGACGGAACAGAAGAACUGCUG<br>GUCAAGCUGAACAGAGAAGACCUGCUGAGAAAGCAGAGAACAUUCGACAACGGAAGCAUCCCGCACCAGAUCCACCUG<br>GGAGAACUGCACGCAAUCCUGAGAAGACAGGAAGACUUCUACCCGUUCCUGAAGGACAACAGAGAAAAGAUCGAAAAG<br>AUCCUGACAUUCAGAAUCCCGUACUACGUCGGACCGCUGGCAAGAGGAAACAGCAGAUUCGCAUGGAUGACAAGAAAG<br>AGCGAAGAAACAAUCACACCGUGGAACUUCGAAGAAGUCGUCGACAAGGGAGCAAGCGCACAGAGCUUCAUCGAAAGA<br>AUGACAAACUUCGACAAGAACCUGCCGAACGAAAAGGUCCUGCCGAAGCACAGCCUGCUGUACGAAUACUUCACAGUC<br>UACAACGAACUGACAAAGGUCAAGUACGUCACAGAAGGAAUGAGAAAGCCGGCAUUCCUGAGCGGAGAACAGAAGAAG<br>GCAAUCGUCGACCUGCUGUUCAAGACAAACAGAAAGGUCACAGUCAAGCAGCUGAAGGAAGACUACUUCAAGAAGAUC<br>GAAUGCUUCGACAGCGUCGAAAUCAGCGGAGUCGAAGACAGAUUCAACGCAAGCCUGGGAACAUACCACGACCUGCUG |

TABLE 5-continued

Exemplary Cas9 mRNA Sequences

| SEQ ID NO | Sequence |
| --- | --- |
| | AAGAUCAUCAAGGACAAGGACUUCCUGGACAACGAAGAAAACGAAGACAUCCUGGAAGACAUCGUCCUGACACUGACA |
| | CUGUUCGAAGACAGAGAAAUGAUCGAAGAAAGACUGAAGACAUACGCACACCUGUUCGACGACAAGGUCAUGAAGCAG |
| | CUGAAGAGAAGAAGAUACACAGGAUGGGGAAGACUGAGCAGAAAGCUGAUCAACGGAAUCAGAGACAAGCAGAGCGG |
| | AAAGACAAUCCUGGACUUCCUGAAGAGCGACGGAUUCGCAAACAGAAACUUCAUGCAGCUGAUCCACGACGACAGCCU |
| | GACAUUCAAGGAAGACAUCCAGAAGGCACAGGUCAGCGGACAGGGAGACAGCCUGCACGAACACAUCGCAAACCUGGC |
| | AGGAAGCCCGGCAAUCAAGAAGGGAAUCCUGCAGACAGUCAAGGUCGUCGACGAACUGGUCAAGGUCAUGGGAAGACA |
| | CAAGCCGGAAAACAUCGUCAUCGAAAUGGCAAGAGAAAACCAGACAACACAGAAGGGACAGAAGAACAGCAGAGAAAG |
| | AAUGAAGAGAAUCGAAGAAGGAAUCAAGGAACUGGGAAGCCAGAUCCUGAAGGAACACCCGGUCGAAAACACACAGCU |
| | GCAGAACGAAAAGCUGUACCUGUACUACCUGCAGAACGGAAGAGACAUGUACGUCGACCAGGAACUGGACAUCAACAG |
| | ACUGAGCGACUACGACGUCGACCACAUCGUCCCGCAGAGCUUCCUGAAGGACGACAGCAUCGACAACAAGGUCCUGAC |
| | AAGAAGCGACAAGAACAGAGGAAAGAGCGACAACGUCCCGAGCGAAGAAGUCGUCAAGAAGAUGAAGAACUACUGGAG |
| | ACAGCUGCUGAACGCAAAGCUGAUCACACAGAGAAAGUUCGACAACCUGACAAAGGCAGAGAGAGGAGGACUGAGCGA |
| | ACUGGACAAGGCAGGAUUCAUCAAGAGACAGCUGGUCGAAACAAGACAGAUCACAAAGCACGUCGCACAGAUCCUGGA |
| | CAGCAGAAUGAACACAAAGUACGACGAAAACGACAAGCUGAUCAGAGAAGUCAAGGUCAUCACACUGAAGAGCAAGCU |
| | GGUCAGCGACUUCAGAAAGGACUUCCAGUUCUACAAGGUCAGAGAAAUCAACAACUACCACCACGCACACGACGCAUA |
| | CCUGAACGCAGUCGUCGGAACAGCACUGAUCAAGAAGUACCCGAAGCUGGAAAGCGAAUUCGUCUACGGAGACUACAA |
| | GGUCUACGACGUCAGAAAGAUGAUCGCAAAGAGCGAACAGGAAAUCGGAAAGGCAACAGCAAAGUACUUCUUCUACAG |
| | CAACAUCAUGAACUUCUUCAAGACAGAAAUCACACUGGCAAACGGAGAAAUCAGAAAGAGACCGCUGAUCGAAACAAA |
| | CGGAGAAACAGGAGAAAUCGUCUGGGACAAGGGAAGAGACUUCGCAACAGUCAGAAAGGUCCUGAGCAUGCCGCAGGU |
| | CAACAUCGUCAAGAAGACAGAAGUCCAGACAGGAGGAUUCAGCAAGGAAAGCAUCCUGCCGAAGAGAAACAGCGACAA |
| | GCUGAUCGCAAGAAAGAAGGACUGGGACCCGAAGAAGUACGGAGGAUUCGACAGCCCGACAGUCGCAUACAGCGUCCU |
| | GGUCGUCGCAAAGGUCGAAAAGGGAAAGAGCAAGAAGCUGAAGAGCGUCAAGGAACUGCUGGGAAUCACAAUCAUGGA |
| | AAGAAGCAGCUUCGAAAAGAACCCGAUCGACUUCCUGGAAGCAAAGGGAUACAAGGAAGUCAAGAAGGACCUGAUCAU |
| | CAAGCUGCCGAAGUACAGCCUGUUCGAACUGGAAAACGGAAGAAAGAGAAUGCUGGCAAGCGCAGGAGAACUGCAGAA |
| | GGGAAACGAACUGGCACUGCCGAGCAAGUACGUCAACUUCCUGUACCUGGCAAGCCACUACGAAAAGCUGAAGGGAAG |
| | CCCGGAAGACAACGAACAGAAGCAGCUGUUCGUCGAACAGCACAAGCACUACCUGGACGAAAUCAUCGAACAGAUCAG |
| | CGAAUUCAGCAAGAGAGUCAUCCUGGCAGACGCAAACCUGGACAAGGUCCUGAGCGCAUACAACAAGCACAGAGACAA |
| | GCCGAUCAGAGAACAGGCAGAAAACAUCAUCCACCUGUUCACACUGACAAACCUGGGAGCACCGGCAGCAUUCAAGUA |
| | CUUCGACACAACAAUCGACAGAAAGAGAUACACAAGCACAAAGGAAGUCCUGGACGCAACACUGAUCCACCAGAGCAU |
| | CACAGGACUGUACGAAACAAGAAUCGACCUGAGCCAGCUGGGAGGAGACUAG |
| 503 | GACAAGAAGUACAGCAUCGGACUGGACAUCGGAACAAACAGCGUCGGAUGGGCAGUCAUCACAGACGAAUACAAGGUC |
| | CCGAGCAAGAAGUUCAAGGUCCUGGGAAACACAGACAGACACAGCAUCAAGAAGAACCUGAUCGGAGCACUGCUGUUC |
| | GACAGCGGAGAAACAGCAGAAGCAACAAGACUGAAGAGAACAGCAAGAAGAAGAUACACAAGAAGAAAGAACAGAAUC |
| | UGCUACCUGCAGGAAAUCUUCAGCAACGAAAUGGCAAAGGUCGACGACAGCUUCUUCCACAGACUGGAAGAAAGCUUC |
| | CUGGUCGAAGAAGACAAGAAGCACGAAAGACACCCGAUCUUCGGAAACAUCGUCGACGAAGUCGCAUACCACGAAAAG |
| | UACCCGACAAUCUACCACCUGAGAAAGAAGCUGGUCGACAGCACAGACAAGGCAGACCUGAGACUGAUCUACCUGGCA |
| | CUGGCACACAUGAUCAAGUUCAGAGGACACUUCCUGAUCGAAGGAGACCUGAACCCGGACAACAGCGACGUCGACAAG |
| | CUGUUCAUCCAGCUGGUCCAGACAUACAACCAGCUGUUCGAAGAAAACCCGAUCAACGCAAGCGGAGUCGACGCAAAG |
| | GCAAUCCUGAGCGCAAGACUGAGCAAGAGCAGAAGACUGGAAAACCUGAUCGCACAGCUGCCGGGAGAAAAGAAGAAC |
| | GGACUGUUCGGAAACCUGAUCGCACUGAGCCUGGGACUGACACCGAACUUCAAGAGCAACUUCGACCUGGCAGAAGAC |
| | GCAAAGCUGCAGCUGAGCAAGGACACAUACGACGACGACCUGGACAACCUGCUGGCACAGAUCGGAGACCAGUACGCA |
| | GACCUGUUCCUGGCAGCAAAGAACCUGAGCGACGCAAUCCUGCUGAGCGACAUCCUGAGAGUCAACACAGAAAUCACA |
| | AAGGCACCGCUGAGCGCAAGCAUGAUCAAGAGAUACGACGAACACCACCAGGACCUGACACUGCUGAAGGCACUGGUC |
| | AGACAGCAGCUGCCGGAAAAGUACAAGGAAAUCUUCUUCGACCAGAGCAAGAACGGAUACGCAGGAUACAUCGACGGA |
| | GGAGCAAGCCAGGAAGAAUUCUACAAGUUCAUCAAGCCGAUCCUGGAAAAGAUGGACGGAACAGAAGAACUGCUGGUC |
| | AAGCUGAACAGAGAAGACCUGCUGAGAAAGCAGAGAACAUUCGACAACGGAAGCAUCCCGCACCAGAUCCACCUGGGA |
| | GAACUGCACGCAAUCCUGAGAAGACAGGAAGACUUCUACCCGUUCCUGAAGGACAACAGAGAAAAGAUCGAAAAGAUC |
| | CUGACAUUCAGAAUCCCGUACUACGUCGGACCGCUGGCAAGAGGAAACAGCAGAUUCGCAUGGAUGACAAGAAAGAGC |
| | GAAGAAACAAUCACACCGUGGAACUUCGAAGAAGUCGUCGACAAGGGAGCAAGCGCACAGAGCUUCAUCGAAAGAAUG |
| | ACAAACUUCGACAAGAACCUGCCGAACGAAAAGGUCCUGCCGAAGCACAGCCUGCUGUACGAAUACUUCACAGUCUAC |
| | AACGAACUGACAAAGGUCAAGUACGUCACAGAAGGAAUGAGAAAGCCGGCAUUCCUGAGCGGAGAACAGAAGAAGGCA |
| | AUCGUCGACCUGCUGUUCAAGACAAACAGAAAGGUCACAGUCAAGCAGCUGAAGGAAGACUACUUCAAGAAGAUCGAA |
| | UGCUUCGACAGCGUCGAAAUCAGCGGAGUCGAAGACAGAUUCAACGCAAGCCUGGGAACAUACCACGACCUGCUGAAG |
| | AUCAUCAAGGACAAGGACUUCCUGGACAACGAAGAAAACGAAGACAUCCUGGAAGACAUCGUCCUGACACUGACACUG |
| | UUCGAAGACAGAGAAAUGAUCGAAGAAAGACUGAAGACAUACGCACACCUGUUCGACGACAAGGUCAUGAAGCAGCUG |
| | AAGAGAAGAAGAUACACAGGAUGGGGAAGACUGAGCAGAAAGCUGAUCAACGGAAUCAGAGACAAGCAGAGCGGAAA |
| | GACAAUCCUGGACUUCCUGAAGAGCGACGGAUUCGCAAACAGAAACUUCAUGCAGCUGAUCCACGACGACAGCCUGAC |
| | AUUCAAGGAAGACAUCCAGAAGGCACAGGUCAGCGGACAGGGAGACAGCCUGCACGAACACAUCGCAAACCUGGCAGG |
| | AAGCCCGGCAAUCAAGAAGGGAAUCCUGCAGACAGUCAAGGUCGUCGACGAACUGGUCAAGGUCAUGGGAAGACACAA |
| | GCCGGAAAACAUCGUCAUCGAAAUGGCAAGAGAAAACCAGACAACACAGAAGGGACAGAAGAACAGCAGAGAAAGAAU |
| | GAAGAGAAUCGAAGAAGGAAUCAAGGAACUGGGAAGCCAGAUCCUGAAGGAACACCCGGUCGAAAACACACAGCUGCA |
| | GAACGAAAAGCUGUACCUGUACUACCUGCAGAACGGAAGAGACAUGUACGUCGACCAGGAACUGGACAUCAACAGACU |
| | GAGCGACUACGACGUCGACCACAUCGUCCCGCAGAGCUUCCUGAAGGACGACAGCAUCGACAACAAGGUCCUGACAAG |
| | AAGCGACAAGAACAGAGGAAAGAGCGACAACGUCCCGAGCGAAGAAGUCGUCAAGAAGAUGAAGAACUACUGGAGACA |
| | GCUGCUGAACGCAAAGCUGAUCACACAGAGAAAGUUCGACAACCUGACAAAGGCAGAGAGAGGAGGACUGAGCGAACU |
| | GGACAAGGCAGGAUUCAUCAAGAGACAGCUGGUCGAAACAAGACAGAUCACAAAGCACGUCGCACAGAUCCUGGACAG |
| | CAGAAUGAACACAAAGUACGACGAAAACGACAAGCUGAUCAGAGAAGUCAAGGUCAUCACACUGAAGAGCAAGCUGGU |
| | CAGCGACUUCAGAAAGGACUUCCAGUUCUACAAGGUCAGAGAAAUCAACAACUACCACCACGCACACGACGCAUACCU |
| | GAACGCAGUCGUCGGAACAGCACUGAUCAAGAAGUACCCGAAGCUGGAAAGCGAAUUCGUCUACGGAGACUACAAGGU |
| | CUACGACGUCAGAAAGAUGAUCGCAAAGAGCGAACAGGAAAUCGGAAAGGCAACAGCAAAGUACUUCUUCUACAGCAA |
| | CAUCAUGAACUUCUUCAAGACAGAAAUCACACUGGCAAACGGAGAAAUCAGAAAGAGACCGCUGAUCGAAACAAACGG |
| | AGAAACAGGAGAAAUCGUCUGGGACAAGGGAAGAGACUUCGCAACAGUCAGAAAGGUCCUGAGCAUGCCGCAGGUCAA |
| | CAUCGUCAAGAAGACAGAAGUCCAGACAGGAGGAUUCAGCAAGGAAAGCAUCCUGCCGAAGAGAAACAGCGACAAGCU |
| | GAUCGCAAGAAAGAAGGACUGGGACCCGAAGAAGUACGGAGGAUUCGACAGCCCGACAGUCGCAUACAGCGUCCUGGU |

TABLE 5-continued

| SEQ ID NO | Sequence |
| --- | --- |
| | Exemplary Cas9 mRNA Sequences |
| | CGUCGCAAAGGUCGAAAAGGGAAAGAGCAAGAAGCUGAAGAGCGUCAAGGAACUGCUGGGAAUCACAAUCAUGGAAAG<br>AAGCAGCUUCGAAAAGAACCCGAUCGACUUCCUGGAAGCAAAGGGAUACAAGGAAGUCAAGAAGGACCUGAUCAUCAA<br>GCUGCCGAAGUACAGCCUGUUCGAACUGGAAAACGGAAGAAAGAGAAUGCUGGCAAGCGCAGGAGAACUGCAGAAGGG<br>AAACGAACUGGCACUGCCGAGCAAGUACGUCAACUUCCUGUACCUGGCAAGCCACUACGAAAAGCUGAAGGGAAGCCC<br>GGAAGACAACGAACAGAAGCAGCUGUUCGUCGAACAGCACAAGCACUACCUGGACGAAAUCAUCGAACAGAUCAGCGA<br>AUUCAGCAAGAGAGUCAUCCUGGCAGACGCAAACCUGGACAAGGUCCUGAGCGCAUACAACAAGCACAGAGACAAGCC<br>GAUCAGAGAACAGGCAGAAAACAUCAUCCACCUGUUCACACUGACAAACCUGGGAGCACCGGCAGCAUUCAAGUACUU<br>CGACACAACAAUCGACAGAAAGAGAUACACAAGCACAAAGGAAGUCCUGGACGCAACACUGAUCCACCAGAGCAUCAC<br>AGGACUGUACGAAACAAGAAUCGACCUGAGCCAGCUGGGAGGAGAC |
| 504 | AUGGACAAGAAGUACAGCAUCGGACUGGACAUCGGAACAAACAGCGUCGGAUGGGCAGUCAUCACAGACGAAUACAAG<br>GUCCCGAGCAAGAAGUUCAAGGUCCUGGGAAACACAGACAGACACAGCAUCAAGAAGAACCUGAUCGGAGCACUGCUG<br>UUCGACAGCGGAGAAACAGCAGAAGCAACAAGACUGAAGAGAACAGCAAGAAGAAGAUACACAAGAAGAAAGAACAGA<br>AUCUGCUACCUGCAGGAAAUCUUCAGCAACGAAAUGGCAAAGGUCGACGACAGCUUCUUCCACAGACUGGAAGAAAGC<br>UUCCUGGUCGAAGAAGACAAGAAGCACGAAAGACACCCGAUCUUCGGAAACAUCGUCGACGAAGUCGCAUACCACGAA<br>AAGUACCCGACAAUCUACCACCUGAGAAAGAAGCUGGUCGACAGCACAGACAAGGCAGACCUGAGACUGAUCUACCUG<br>GCACUGGCACACAUGAUCAAGUUCAGAGGACACUUCCUGAUCGAAGGAGACCUGAACCCGGACAACAGCGACGUCGAC<br>AAGCUGUUCAUCCAGCUGGUCCAGACAUACAACCAGCUGUUCGAAGAAAACCCGAUCAACGCAAGCGGAGUCGACGCA<br>AAGGCAAUCCUGAGCGCAAGACUGAGCAAGAGCAGAAGACUGGAAAACCUGAUCGCACAGCUGCCGGGAGAAAAGAAG<br>AACGGACUGUUCGGAAACCUGAUCGCACUGAGCCUGGGACUGACACCGAACUUCAAGAGCAACUUCGACCUGGCAGAA<br>GACGCAAAGCUGCAGCUGAGCAAGGACACAUACGACGACGACCUGGACAACCUGCUGGCACAGAUCGGAGACCAGUAC<br>GCAGACCUGUUCCUGGCAGCAAAGAACCUGAGCGACGCAAUCCUGCUGAGCGACAUCCUGAGAGUCAACACAGAAAUC<br>ACAAAGGCACCGCUGAGCGCAAGCAUGAUCAAGAGAUACGACGAACACCACCAGGACCUGACACUGCUGAAGGCACUG<br>GUCAGACAGCAGCUGCCGGAAAAGUACAAGGAAAUCUUCUUCGACCAGAGCAAGAACGGAUACGCAGGAUACAUCGAC<br>GGAGGAGCAAGCCAGGAAGAAUUCUACAAGUUCAUCAAGCCGAUCCUGGAAAAGAUGGACGGAACAGAAGAACUGCUG<br>GUCAAGCUGAACAGAGAAGACCUGCUGAGAAAGCAGAGAACAUUCGACAACGGAAGCAUCCCGCACCAGAUCCACCUG<br>GGAGAACUGCACGCAAUCCUGAGAAGACAGGAAGACUUCUACCCGUUCCUGAAGGACAACAGAGAAAAGAUCGAAAAG<br>AUCCUGACAUUCAGAAUCCCGUACUACGUCGGACCGCUGGCAAGAGGAAACAGCAGAUUCGCAUGGAUGACAAGAAAG<br>AGCGAAGAAACAAUCACACCGUGGAACUUCGAAGAAGUCGUCGACAAGGGAGCAAGCGCACAGAGCUUCAUCGAAAGA<br>AUGACAAACUUCGACAAGAACCUGCCGAACGAAAAGGUCCUGCCGAAGCACAGCCUGCUGUACGAAUACUUCACAGUC<br>UACAACGAACUGACAAAGGUCAAGUACGUCACAGAAGGAAUGAGAAAGCCGGCAUUCCUGAGCGGAGAACAGAAGAAG<br>GCAAUCGUCGACCUGCUGUUCAAGACAAACAGAAAGGUCACAGUCAAGCAGCUGAAGGAAGACUACUUCAAGAAGAUC<br>GAAUGCUUCGACAGCGUCGAAAUCAGCGGAGUCGAAGACAGAUUCAACGCAAGCCUGGGAACAUACCACGACCUGCUG<br>AAGAUCAUCAAGGACAAGGACUUCCUGGACAACGAAGAAAACGAAGACAUCCUGGAAGACAUCGUCCUGACACUGACA<br>CUGUUCGAAGACAGAGAAAUGAUCGAAGAAAGACUGAAGACAUACGCACACCUGUUCGACGACAAGGUCAUGAAGCAG<br>CUGAAGAGAAGAAGAUACACAGGAUGGGGAAGACUGAGCAGAAAGCUGAUCAACGGAAUCAGAGACAAGCAGAGCGG<br>AAAGACAAUCCUGGACUUCCUGAAGAGCGACGGAUUCGCAAACAGAAACUUCAUGCAGCUGAUCCACGACGACAGCCU<br>GACAUUCAAGGAAGACAUCCAGAAGGCACAGGUCAGCGGACAGGGAGACAGCCUGCACGAACACAUCGCAAACCUGGC<br>AGGAAGCCCGGCAAUCAAGAAGGGAAUCCUGCAGACAGUCAAGGUCGUCGACGAACUGGUCAAGGUCAUGGGAAGACA<br>CAAGCCGGAAAACAUCGUCAUCGAAAUGGCAAGAGAAAACCAGACAACACAGAAGGGACAGAAGAACAGCAGAGAAAG<br>AAUGAAGAGAAUCGAAGAAGGAAUCAAGGAACUGGGAAGCCAGAUCCUGAAGGAACACCCGGUCGAAAACACACAGCU<br>GCAGAACGAAAAGCUGUACCUGUACUACCUGCAGAACGGAAGAGACAUGUACGUCGACCAGGAACUGGACAUCAACAG<br>ACUGAGCGACUACGACGUCGACCACAUCGUCCCGCAGAGCUUCCUGAAGGACGACAGCAUCGACAACAAGGUCCUGAC<br>AAGAAGCGACAAGAACAGAGGAAAGAGCGACAACGUCCCGAGCGAAGAAGUCGUCAAGAAGAUGAAGAACUACUGGAG<br>ACAGCUGCUGAACGCAAAGCUGAUCACACAGAGAAAGUUCGACAACCUGACAAAGGCAGAGAGAGGAGGACUGAGCGA<br>ACUGGACAAGGCAGGAUUCAUCAAGAGACAGCUGGUCGAAACAAGACAGAUCACAAAGCACGUCGCACAGAUCCUGGA<br>CAGCAGAAUGAACACAAAGUACGACGAAAACGACAAGCUGAUCAGAGAAGUCAAGGUCAUCACACUGAAGAGCAAGCU<br>GGUCAGCGACUUCAGAAAGGACUUCCAGUUCUACAAGGUCAGAGAAAUCAACAACUACCACCACGCACACGACGCAUA<br>CCUGAACGCAGUCGUCGGAACAGCACUGAUCAAGAAGUACCCGAAGCUGGAAAGCGAAUUCGUCUACGGAGACUACAA<br>GGUCUACGACGUCAGAAAGAUGAUCGCAAAGAGCGAACAGGAAAUCGGAAAGGCAACAGCAAAGUACUUCUUCUACAG<br>CAACAUCAUGAACUUCUUCAAGACAGAAAUCACACUGGCAAACGGAGAAAUCAGAAAGAGACCGCUGAUCGAAACAAA<br>CGGAGAAACAGGAGAAAUCGUCUGGGACAAGGGAAGAGACUUCGCAACAGUCAGAAAGGUCCUGAGCAUGCCGCAGGU<br>CAACAUCGUCAAGAAGACAGAAGUCCAGACAGGAGGAUUCAGCAAGGAAAGCAUCCUGCCGAAGAGAAACAGCGACAA<br>GCUGAUCGCAAGAAAGAAGGACUGGGACCCGAAGAAGUACGGAGGAUUCGACAGCCCGACAGUCGCAUACAGCGUCCU<br>GGUCGUCGCAAAGGUCGAAAAGGGAAAGAGCAAGAAGCUGAAGAGCGUCAAGGAACUGCUGGGAAUCACAAUCAUGGA<br>AAGAAGCAGCUUCGAAAAGAACCCGAUCGACUUCCUGGAAGCAAAGGGAUACAAGGAAGUCAAGAAGGACCUGAUCAU<br>CAAGCUGCCGAAGUACAGCCUGUUCGAACUGGAAAACGGAAGAAAGAGAAUGCUGGCAAGCGCAGGAGAACUGCAGAA<br>GGGAAACGAACUGGCACUGCCGAGCAAGUACGUCAACUUCCUGUACCUGGCAAGCCACUACGAAAAGCUGAAGGGAAG<br>CCCGGAAGACAACGAACAGAAGCAGCUGUUCGUCGAACAGCACAAGCACUACCUGGACGAAAUCAUCGAACAGAUCAG<br>CGAAUUCAGCAAGAGAGUCAUCCUGGCAGACGCAAACCUGGACAAGGUCCUGAGCGCAUACAACAAGCACAGAGACAA<br>GCCGAUCAGAGAACAGGCAGAAAACAUCAUCCACCUGUUCACACUGACAAACCUGGGAGCACCGGCAGCAUUCAAGUA<br>CUUCGACACAACAAUCGACAGAAAGAGAUACACAAGCACAAAGGAAGUCCUGGACGCAACACUGAUCCACCAGAGCAU<br>CACAGGACUGUACGAAACAAGAAUCGACCUGAGCCAGCUGGGAGGAGACGGAAGCGGAAGCCCGAAGAAGAAGAGAAA<br>GGUCGACGGAAGCCCGAAGAAGAAGAGAAAGGUCGACAGCGGAUAG |
| 505 | GACAAGAAGUACAGCAUCGGACUGGACAUCGGAACAAACAGCGUCGGAUGGGCAGUCAUCACAGACGAAUACAAGGUC<br>CCGAGCAAGAAGUUCAAGGUCCUGGGAAACACAGACAGACACAGCAUCAAGAAGAACCUGAUCGGAGCACUGCUGUUC<br>GACAGCGGAGAAACAGCAGAAGCAACAAGACUGAAGAGAACAGCAAGAAGAAGAUACACAAGAAGAAAGAACAGAAUC<br>UGCUACCUGCAGGAAAUCUUCAGCAACGAAAUGGCAAAGGUCGACGACAGCUUCUUCCACAGACUGGAAGAAAGCUUC<br>CUGGUCGAAGAAGACAAGAAGCACGAAAGACACCCGAUCUUCGGAAACAUCGUCGACGAAGUCGCAUACCACGAAAAG<br>UACCCGACAAUCUACCACCUGAGAAAGAAGCUGGUCGACAGCACAGACAAGGCAGACCUGAGACUGAUCUACCUGGCA<br>CUGGCACACAUGAUCAAGUUCAGAGGACACUUCCUGAUCGAAGGAGACCUGAACCCGGACAACAGCGACGUCGACAAG<br>CUGUUCAUCCAGCUGGUCCAGACAUACAACCAGCUGUUCGAAGAAAACCCGAUCAACGCAAGCGGAGUCGACGCAAAG<br>GCAAUCCUGAGCGCAAGACUGAGCAAGAGCAGAAGACUGGAAAACCUGAUCGCACAGCUGCCGGGAGAAAAGAAGAAC<br>GGACUGUUCGGAAACCUGAUCGCACUGAGCCUGGGACUGACACCGAACUUCAAGAGCAACUUCGACCUGGCAGAAGAC |

TABLE 5-continued

Exemplary Cas9 mRNA Sequences

| SEQ ID NO | Sequence |
|---|---|
| | GCAAAGCUGCAGCUGAGCAAGGACACAUACGACGACGACCUGGACAACCUGCUGGCACAGAUCGGAGACCAGUACGCA<br>GACCUGUUCCUGGCAGCAAAGAACCUGAGCGACGCAAUCCUGCUGAGCGACAUCCUGAGAGUCAACACAGAAAUCACA<br>AAGGCACCGCUGAGCGCAAGCAUGAUCAAGAGAUACGACGAACACCACCAGGACCUGACACUGCUGAAGGCACUGGUC<br>AGACAGCAGCUGCCGGAAAAGUACAAGGAAAUCUUCUUCGACCAGAGCAAGAACGGAUACGCAGGAUACAUCGACGGA<br>GGAGCAAGCCAGGAAGAAUUCUACAAGUUCAUCAAGCCGAUCCUGGAAAAGAUGGACGGAACAGAAGAACUGCUGGUC<br>AAGCUGAACAGAGAAGACCUGCUGAGAAAGCAGAGAACAUUCGACAACGGAAGCAUCCCGCACCAGAUCCACCUGGGA<br>GAACUGCACGCAAUCCUGAGAAGACAGGAAGACUUCUACCCGUUCCUGAAGGACAACAGAGAAAAGAUCGAAAAGAUC<br>CUGACAUUCAGAAUCCCGUACUACGUCGGACCGCUGGCAAGAGGAAACAGCAGAUUCGCAUGGAUGACAAGAAAGAGC<br>GAAGAAACAAUCACACCGUGGAACUUCGAAGAAGUCGUCGACAAGGGAGCAAGCGCACAGAGCUUCAUCGAAAGAAUG<br>ACAAACUUCGACAAGAACCUGCCGAACGAAAAGGUCCUGCCGAAGCACAGCCUGCUGUACGAAUACUUCACAGUCUAC<br>AACGAACUGACAAAGGUCAAGUACGUCACAGAAGGAAUGAGAAAGCCGGCAUUCCUGAGCGGAGAACAGAAGAAGGCA<br>AUCGUCGACCUGCUGUUCAAGACAAACAGAAAGGUCACAGUCAAGCAGCUGAAGGAAGACUACUUCAAGAAGAUCGAA<br>UGCUUCGACAGCGUCGAAAUCAGCGGAGUCGAAGACAGAUUCAACGCAAGCCUGGGAACAUACCACGACCUGCUGAAG<br>AUCAUCAAGGACAAGGACUUCCUGGACAACGAAGAAAACGAAGACAUCCUGGAAGACAUCGUCCUGACACUGACACUG<br>UUCGAAGACAGAGAAAUGAUCGAAGAAAGACUGAAGACAUACGCACACCUGUUCGACGACAAGGUCAUGAAGCAGCUG<br>AAGAGAAGAAGAUACACAGGAUGGGGAAGACUGAGCAGAAAGCUGAUCAACGGAAUCAGAGACAAGCAGAGCGGAAA<br>GACAAUCCUGGACUUCCUGAAGAGCGACGGAUUCGCAAACAGAAACUUCAUGCAGCUGAUCCACGACGACAGCCUGAC<br>AUUCAAGGAAGACAUCCAGAAGGCACAGGUCAGCGGACAGGGAGACAGCCUGCACGAACACAUCGCAAACCUGGCAGG<br>AAGCCCGGCAAUCAAGAAGGGAAUCCUGCAGACAGUCAAGGUCGUCGACGAACUGGUCAAGGUCAUGGGAAGACACAA<br>GCCGGAAAACAUCGUCAUCGAAAUGGCAAGAGAAAACCAGACAACACAGAAGGGACAGAAGAACAGCAGAGAAAGAAU<br>GAAGAGAAUCGAAGAAGGAAUCAAGGAACUGGGAAGCCAGAUCCUGAAGGAACACCCGGUCGAAAACACACAGCUGCA<br>GAACGAAAAGCUGUACCUGUACUACCUGCAGAACGGAAGAGACAUGUACGUCGACCAGGAACUGGACAUCAACAGACU<br>GAGCGACUACGACGUCGACCACAUCGUCCCGCAGAGCUUCCUGAAGGACGACAGCAUCGACAACAAGGUCCUGACAAG<br>AAGCGACAAGAACAGAGGAAAGAGCGACAACGUCCCGAGCGAAGAAGUCGUCAAGAAGAUGAAGAACUACUGGAGACA<br>GCUGCUGAACGCAAAGCUGAUCACACAGAGAAAGUUCGACAACCUGACAAAGGCAGAGAGAGGAGGACUGAGCGAACU<br>GGACAAGGCAGGAUUCAUCAAGAGACAGCUGGUCGAAACAAGACAGAUCACAAAGCACGUCGCACAGAUCCUGGACAG<br>CAGAAUGAACACAAAGUACGACGAAAACGACAAGCUGAUCAGAGAAGUCAAGGUCAUCACACUGAAGAGCAAGCUGGU<br>CAGCGACUUCAGAAAGGACUUCCAGUUCUACAAGGUCAGAGAAAUCAACAACUACCACCACGCACACGACGCAUACCU<br>GAACGCAGUCGUCGGAACAGCACUGAUCAAGAAGUACCCGAAGCUGGAAAGCGAAUUCGUCUACGGAGACUACAAGGU<br>CUACGACGUCAGAAAGAUGAUCGCAAAGAGCGAACAGGAAAUCGGAAAGGCAACAGCAAAGUACUUCUUCUACAGCAA<br>CAUCAUGAACUUCUUCAAGACAGAAAUCACACUGGCAAACGGAGAAAUCAGAAAGAGACCGCUGAUCGAAACAAACGG<br>AGAAACAGGAGAAAUCGUCUGGGACAAGGGAAGAGACUUCGCAACAGUCAGAAAGGUCCUGAGCAUGCCGCAGGUCAA<br>CAUCGUCAAGAAGACAGAAGUCCAGACAGGAGGAUUCAGCAAGGAAAGCAUCCUGCCGAAGAGAAACAGCGACAAGCU<br>GAUCGCAAGAAAGAAGGACUGGGACCCGAAGAAGUACGGAGGAUUCGACAGCCCGACAGUCGCAUACAGCGUCCUGGU<br>CGUCGCAAAGGUCGAAAAGGGAAAGAGCAAGAAGCUGAAGAGCGUCAAGGAACUGCUGGGAAUCACAAUCAUGGAAAG<br>AAGCAGCUUCGAAAAGAACCCGAUCGACUUCCUGGAAGCAAAGGGAUACAAGGAAGUCAAGAAGGACCUGAUCAUCAA<br>GCUGCCGAAGUACAGCCUGUUCGAACUGGAAAACGGAAGAAAGAGAAUGCUGGCAAGCGCAGGAGAACUGCAGAAGGG<br>AAACGAACUGGCACUGCCGAGCAAGUACGUCAACUUCCUGUACCUGGCAAGCCACUACGAAAAGCUGAAGGGAAGCCC<br>GGAAGACAACGAACAGAAGCAGCUGUUCGUCGAACAGCACAAGCACUACCUGGACGAAAUCAUCGAACAGAUCAGCGA<br>AUUCAGCAAGAGAGUCAUCCUGGCAGACGCAAACCUGGACAAGGUCCUGAGCGCAUACAACAAGCACAGAGACAAGCC<br>GAUCAGAGAACAGGCAGAAAACAUCAUCCACCUGUUCACACUGACAAACCUGGGAGCACCGGCAGCAUUCAAGUACUU<br>CGACACAACAAUCGACAGAAAGAGAUACACAAGCACAAAGGAAGUCCUGGACGCAACACUGAUCCACCAGAGCAUCAC<br>AGGACUGUACGAAACAAGAAUCGACCUGAGCCAGCUGGGAGGAGACGGAAGCGGAAGCCCGAAGAAGAAGAGAAAGGU<br>CGACGGAAGCCCGAAGAAGAAGAGAAAGGUCGACAGCGGA |
| 506 | GGGTCCCGCAGTCGGCGTCCAGCGGCTCTGCTTGTTCGTGTGTGTGTCGTTGCAGGCCTTATTCGGATCCATGGACAAGAAG<br>TACAGCATCGGACTGGACATCGGAACAAACAGCGTCGGATGGGCAGTCATCACAGACGAATACAAGGTCCCGAGCAAGAA<br>GTTCAAGGTCCTGGGAAACACAGACAGACACAGCATCAAGAAGAACCTGATCGGAGCACTGCTGTTCGACAGCGGAGAAA<br>CAGCAGAAGCAACAAGACTGAAGAGAACAGCAAGAAGAAGATACACAAGAAGAAAGAACAGAATCTGCTACCTGCAGGA<br>AATCTTCAGCAACGAAATGGCAAAGGTCGACGACAGCTTCTTCCACAGACTGGAAGAAAGCTTCCTGGTCGAAGAAGACA<br>AGAAGCACGAAAGACACCCGATCTTCGGAAACATCGTCGACGAAGTCGCATACCACGAAAAGTACCCGACAATCTACCAC<br>CTGAGAAAGAAGCTGGTCGACAGCACAGACAAGGCAGACCTGAGACTGATCTACCTGGCACTGGCACACATGATCAAGTT<br>CAGAGGACACTTCCTGATCGAAGGAGACCTGAACCCGGACAACAGCGACGTCGACAAGCTGTTCATCCAGCTGGTCCAGA<br>CATACAACCAGCTGTTCGAAGAAAACCCGATCAACGCAAGCGGAGTCGACGCAAAGGCAATCCTGAGCGCAAGACTGAGC<br>AAGAGCAGAAGACTGGAAAACCTGATCGCACAGCTGCCGGGAGAAAAGAAGAACGGACTGTTCGGAAACCTGATCGCAC<br>TGAGCCTGGGACTGACACCGAACTTCAAGAGCAACTTCGACCTGGCAGAAGACGCAAAGCTGCAGCTGAGCAAGGACACA<br>TACGACGACGACCTGGACAACCTGCTGGCACAGATCGGAGACCAGTACGCAGACCTGTTCCTGGCAGCAAAGAACCTGAG<br>CGACGCAATCCTGCTGAGCGACATCCTGAGAGTCAACACAGAAATCACAAAGGCACCGCTGAGCGCAAGCATGATCAAGA<br>GATACGACGAACACCACCAGGACCTGACACTGCTGAAGGCACTGGTCAGACAGCAGCTGCCGGAAAAGTACAAGGAAATC<br>TTCTTCGACCAGAGCAAGAACGGATACGCAGGATACATCGACGGAGGAGCAAGCCAGGAAGAATTCTACAAGTTCATCAA<br>GCCGATCCTGGAAAAGATGGACGGAACAGAAGAACTGCTGGTCAAGCTGAACAGAGAAGACCTGCTGAGAAAGCAGAGA<br>ACATTCGACAACGGAAGCATCCCGCACCAGATCCACCTGGGAGAACTGCACGCAATCCTGAGAAGACAGGAAGACTTCTA<br>CCCGTTCCTGAAGGACAACAGAGAAAAGATCGAAAAGATCCTGACATTCAGAATCCCGTACTACGTCGGACCGCTGGCAA<br>GAGGAAACAGCAGATTCGCATGGATGACAAGAAAGAGCGAAGAAACAATCACACCGTGGAACTTCGAAGAAGTCGTCGA<br>CAAGGGAGCAAGCGCACAGAGCTTCATCGAAAGAATGACAAACTTCGACAAGAACCTGCCGAACGAAAAGGTCCTGCCGA<br>AGCACAGCCTGCTGTACGAATACTTCACAGTCTACAACGAACTGACAAAGGTCAAGTACGTCACAGAAGGAATGAGAAAG<br>CCGGCATTCCTGAGCGGAGAACAGAAGAAGGCAATCGTCGACCTGCTGTTCAAGACAAACAGAAAGGTCACAGTCAAGCA<br>GCTGAAGGAAGACTACTTCAAGAAGATCGAATGCTTCGACAGCGTCGAAATCAGCGGAGTCGAAGACAGATTCAACGCAA<br>GCCTGGGAACATACCACGACCTGCTGAAGATCATCAAGGACAAGGACTTCCTGGACAACGAAGAAAACGAAGACATCCTG<br>GAAGACATCGTCCTGACACTGACACTGTTCGAAGACAGAGAAATGATCGAAGAAAGACTGAAGACATACGCACACCTGTT<br>CGACGACAAGGTCATGAAGCAGCTGAAGAGAAGAAGATACACAGGATGGGGAAGACTGAGCAGAAAGCTGATCAACGGA<br>ATCAGAGACAAGCAGAGCGGAAAGACAATCCTGGACTTCCTGAAGAGCGACGGATTCGCAAACAGAAACTTCATGCAGCT<br>GATCCACGACGACAGCCTGACATTCAAGGAAGACATCCAGAAGGCACAGGTCAGCGGACAGGGAGACAGCCTGCACGAA<br>CACATCGCAAACCTGGCAGGAAGCCCGGCAATCAAGAAGGGAATCCTGCAGACAGTCAAGGTCGTCGACGAACTGGTCAA<br>GGTCATGGGAAGACACAAGCCGGAAAACATCGTCATCGAAATGGCAAGAGAAAACCAGACAACACAGAAGGGACAGAAG |

TABLE 5-continued

| Exemplary Cas9 mRNA Sequences | |
|---|---|
| SEQ ID NO | Sequence |
| | AACAGCAGAGAAAGAATGAAGAGAATCGAAGAAGGAATCAAGGAACTGGGAAGCCAGATCCTGAAGGAACACCCGGTCG<br>AAAACACACAGCTGCAGAACGAAAAGCTGTACCTGTACTACCTGCAGAACGGAAGAGACATGTACGTCGACCAGGAACTG<br>GACATCAACAGACTGAGCGACTACGACGTCGACCACATCGTCCCGCAGAGCTTCCTGAAGGACGACAGCATCGACAACAA<br>GGTCCTGACAAGAAGCGACAAGAACAGAGGAAAGAGCGACAACGTCCCGAGCGAAGAAGTCGTCAAGAAGATGAAGAAC<br>TACTGGAGACAGCTGCTGAACGCAAAGCTGATCACACAGAGAAAGTTCGACAACCTGACAAAGGCAGAGAGAGGAGGAC<br>TGAGCGAACTGGACAAGGCAGGATTCATCAAGAGACAGCTGGTCGAAACAAGACAGATCACAAAGCACGTCGCACAGATC<br>CTGGACAGCAGAATGAACACAAAGTACGACGAAAACGACAAGCTGATCAGAGAAGTCAAGGTCATCACACTGAAGAGCA<br>AGCTGGTCAGCGACTTCAGAAAGGACTTCCAGTTCTACAAGGTCAGAGAAATCAACAACTACCACCACGCACACGACGCA<br>TACCTGAACGCAGTCGTCGGAACAGCACTGATCAAGAAGTACCCGAAGCTGGAAAGCGAATTCGTCTACGGAGACTACAA<br>GGTCTACGACGTCAGAAAGATGATCGCAAAGAGCGAACAGGAAATCGGAAAGGCAACAGCAAAGTACTTCTTCTACAGCA<br>ACATCATGAACTTCTTCAAGACAGAAATCACACTGGCAAACGGAGAAATCAGAAAGAGACCGCTGATCGAAACAAACGGA<br>GAAACAGGAGAAATCGTCTGGGACAAGGGAAGAGACTTCGCAACAGTCAGAAAGGTCCTGAGCATGCCGCAGGTCAACAT<br>CGTCAAGAAGACAGAAGTCCAGACAGGAGGATTCAGCAAGGAAAGCATCCTGCCGAAGAGAAACAGCGACAAGCTGATC<br>GCAAGAAAGAAGGACTGGGACCCGAAGAAGTACGGAGGATTCGACAGCCCGACAGTCGCATACAGCGTCCTGGTCGTCGC<br>AAAGGTCGAAAAGGGAAAGAGCAAGAAGCTGAAGAGCGTCAAGGAACTGCTGGGAATCACAATCATGGAAAGAAGCAGC<br>TTCGAAAAGAACCCGATCGACTTCCTGGAAGCAAAGGGATACAAGGAAGTCAAGAAGGACCTGATCATCAAGCTGCCGAA<br>GTACAGCCTGTTCGAACTGGAAAACGGAAGAAAGAGAATGCTGGCAAGCGCAGGAGAACTGCAGAAGGGAAACGAACTG<br>GCACTGCCGAGCAAGTACGTCAACTTCCTGTACCTGGCAAGCCACTACGAAAAGCTGAAGGGAAGCCCGGAAGACAACGA<br>ACAGAAGCAGCTGTTCGTCGAACAGCACAAGCACTACCTGGACGAAATCATCGAACAGATCAGCGAATTCAGCAAGAGAG<br>TCATCCTGGCAGACGCAAACCTGGACAAGGTCCTGAGCGCATACAACAAGCACAGAGACAAGCCGATCAGAGAACAGGC<br>AGAAAACATCATCCACCTGTTCACACTGACAAACCTGGGAGCACCGGCAGCATTCAAGTACTTCGACACAACAATCGACA<br>GAAAGAGATACACAAGCACAAAGGAAGTCCTGGACGCAACACTGATCCACCAGAGCATCACAGGACTGTACGAAACAAG<br>AATCGACCTGAGCCAGCTGGGAGGAGACGGAGGAGGAAGCCCGAAGAAGAAGAGAAAGGTCTAGCTAGCCATCACATTT<br>AAAAGCATCTCAGCCTACCATGAGAATAAGAGAAAGAAAATGAAGATCAATAGCTTATTCATCTCTTTTTCTTTTTCGTTGG<br>TGTAAAGCCAACACCCTGTCTAAAAAACATAAATTTCTTTAATCATTTTGCCTCTTTTCTCTGTGCTTCAATTAATAAAAAAT<br>GGAAAGAACCTCGAG |
| 507 | ATGGACAAGAAGTACAGCATCGGACTGGACATCGGAACAAACAGCGTCGGATGGGCAGTCATCACAGACGAATACAAGGT<br>CCCGAGCAAGAAGTTCAAGGTCCTGGGAAACACAGACAGACACAGCATCAAGAAGAACCTGATCGGAGCACTGCTGTTCG<br>ACAGCGGAGAAACAGCAGAAGCAACAAGACTGAAGAGAACAGCAAGAAGAAGATACACAAGAAGAAAGAACAGAATCT<br>GCTACCTGCAGGAAATCTTCAGCAACGAAATGGCAAAGGTCGACGACAGCTTCTTCCACcggCTGGAAGAAAGCTTCCTGGT<br>CGAAGAAGACAAGAAGCACGAAAGACACCCGATCTTCGGAAACATCGTCGACGAAGTCGCATACCACGAAAAGTACCCG<br>ACAATCTACCACCTGAGAAAGAAGCTGGTCGACAGCACAGACAAGGCAGACCTGAGACTGATCTACCTGGCACTGGCACA<br>CATGATCAAGTTCAGAGGACACTTCCTGATCGAAGGAGACCTGAACCCGGACAACAGCGACGTCGACAAGCTGTTCATCC<br>AGCTGGTCCAGACATACAACCAGCTGTTCGAAGAAAACCCGATCAACGCAAGCGGAGTCGACGCAAAGGCAATCCTGAGC<br>GCAAGACTGAGCAAGAGCAGAAGACTGGAAAACCTGATCGCACAGCTGCCGGGAGAAAAGAAGAACGGACTGTTCGGAA<br>ACCTGATCGCACTGAGCCTGGGACTGACACCGAACTTCAAGAGCAACTTCGACCTGGCAGAAGACGCAAAGCTGCAGCTG<br>AGCAAGGACACATACGACGACGACCTGGACAACCTGCTGGCACAGATCGGAGACCAGTACGCAGACCTGTTCCTGGCAGC<br>AAAGAACCTGAGCGACGCAATCCTGCTGAGCGACATCCTGAGAGTCAACACAGAAATCACAAAGGCACCGCTGAGCGCAA<br>GCATGATCAAGAGATACGACGAACACCACCAGGACCTGACACTGCTGAAGGCACTGGTCAGACAGCAGCTGCCGGAAAAG<br>TACAAGGAAATCTTCTTCGACCAGAGCAAGAACGGATACGCAGGATACATCGACGGAGGAGCAAGCCAGGAAGAATTCTA<br>CAAGTTCATCAAGCCGATCCTGGAAAAGATGGACGGAACAGAAGAACTGCTGGTCAAGCTGAACAGAGAAGACCTGCTGA<br>GAAAGCAGAGAACATTCGACAACGGAAGCATCCCGCACCAGATCCACCTGGGAGAACTGCACGCAATCCTGAGAAGACA<br>GGAAGACTTCTACCCGTTCCTGAAGGACAACAGAGAAAAGATCGAAAAGATCCTGACATTCAGAATCCCGTACTACGTCG<br>GACCGCTGGCAAGAGGAAACAGCAGATTCGCATGGATGACAAGAAAGAGCGAAGAAACAATCACACCGTGGAACTTCGA<br>AGAAGTCGTCGACAAGGGAGCAAGCGCACAGAGCTTCATCGAAAGAATGACAAACTTCGACAAGAACCTGCCGAACGAA<br>AAGGTCCTGCCGAAGCACAGCCTGCTGTACGAATACTTCACAGTCTACAACGAACTGACAAAGGTCAAGTACGTCACAGA<br>AGGAATGAGAAAGCCGGCATTCCTGAGCGGAGAACAGAAGAAGGCAATCGTCGACCTGCTGTTCAAGACAAACAGAAAG<br>GTCACAGTCAAGCAGCTGAAGGAAGACTACTTCAAGAAGATCGAATGCTTCGACAGCGTCGAAATCAGCGGAGTCGAAGA<br>CAGATTCAACGCAAGCCTGGGAACATACCACGACCTGCTGAAGATCATCAAGGACAAGGACTTCCTGGACAACGAAGAAA<br>ACGAAGACATCCTGGAAGACATCGTCCTGACACTGACACTGTTCGAAGACAGAGAAATGATCGAAGAAAGACTGAAGACA<br>TACGCACACCTGTTCGACGACAAGGTCATGAAGCAGCTGAAGAGAAGAAGATACACAGGATGGGGAAGACTGAGCAGAA<br>AGCTGATCAACGGAATCAGAGACAAGCAGAGCGGAAAGACAATCCTGGACTTCCTGAAGAGCGACGGATTCGCAAACAG<br>AAACTTCATGCAGCTGATCCACGACGACAGCCTGACATTCAAGGAAGACATCCAGAAGGCACAGGTCAGCGGACAGGGAG<br>ACAGCCTGCACGAACACATCGCAAACCTGGCAGGAAGCCCGGCAATCAAGAAGGGAATCCTGCAGACAGTCAAGGTCGTC<br>GACGAACTGGTCAAGGTCATGGGAAGACACAAGCCGGAAAACATCGTCATCGAAATGGCAAGAGAAAACCAGACAACAC<br>AGAAGGGACAGAAGAACAGCAGAGAAAGAATGAAGAGAATCGAAGAAGGAATCAAGGAACTGGGAAGCCAGATCCTGA<br>AGGAACACCCGGTCGAAAACACACAGCTGCAGAACGAAAAGCTGTACCTGTACTACCTGCAaAACGGAAGAGACATGTAC<br>GTCGACCAGGAACTGGACATCAACAGACTGAGCGACTACGACGTCGACCACATCGTCCCGCAGAGCTTCCTGAAGGACGA<br>CAGCATCGACAACAAGGTCCTGACAAGAAGCGACAAGAACAGAGGAAAGAGCGACAACGTCCCGAGCGAAGAAGTCGTC<br>AAGAAGATGAAGAACTACTGGAGACAGCTGCTGAACGCAAAGCTGATCACACAGAGAAAGTTCGACAACCTGACAAAGG<br>CAGAGAGAGGAGGACTGAGCGAACTGGACAAGGCAGGATTCATCAAGAGACAGCTGGTCGAAACAAGACAGATCACAAA<br>GCACGTCGCACAGATCCTGGACAGCAGAATGAACACAAAGTACGACGAAAACGACAAGCTGATCAGAGAAGTCAAGGTC<br>ATCACACTGAAGAGCAAGCTGGTCAGCGACTTCAGAAAGGACTTCCAGTTCTACAAGGTCAGAGAAATCAACAACTACCA<br>CCACGCACACGACGCATACCTGAACGCAGTCGTCGGAACAGCACTGATCAAGAAGTACCCGAAGCTGGAAAGCGAATTCG<br>TCTACGGAGACTACAAGGTCTACGACGTCAGAAAGATGATCGCAAAGAGCGAACAGGAAATCGGAAAGGCAACAGCAAA<br>GTACTTCTTCTACAGCAACATCATGAACTTCTTCAAGACAGAAATCACACTGGCAAACGGAGAAATCAGAAAGAGACCGCT<br>GATCGAAACAAACGGAGAAACAGGAGAAATCGTCTGGGACAAGGGAAGAGACTTCGCAACAGTCAGAAAGGTCCTGAGC<br>ATGCCGCAGGTCAACATCGTCAAGAAGACAGAAGTCCAGACAGGAGGATTCAGCAAGGAAAGCATCCTGCCGAAGAGAA<br>ACAGCGACAAGCTGATCGCAAGAAAGAAGGACTGGGACCCGAAGAAGTACGGAGGATTCGACAGCCCGACAGTCGCATA<br>CAGCGTCCTGGTCGTCGCAAAGGTCGAAAAGGGAAAGAGCAAGAAGCTGAAGAGCGTCAAGGAACTGCTGGGAATCACA<br>ATCATGGAAAGAAGCAGCTTCGAAAAGAACCCGATCGACTTCCTGGAAGCAAAGGGATACAAGGAAGTCAAGAAGGACC<br>TGATCATCAAGCTGCCGAAGTACAGCCTGTTCGAACTGGAAAACGGAAGAAAGAGAATGCTGGCAAGCGCAGGAGAACTG<br>CAGAAGGGAAACGAACTGGCACTGCCGAGCAAGTACGTCAACTTCCTGTACCTGGCAAGCCACTACGAAAAGCTGAAGGG<br>AAGCCCGGAAGACAACGAACAGAAGCAGCTGTTCGTCGAACAGCACAAGCACTACCTGGACGAAATCATCGAACAGATCA |

TABLE 5-continued

Exemplary Cas9 mRNA Sequences

| SEQ ID NO | Sequence |
|---|---|
| | GCGAATTCAGCAAGAGAGTCATCCTGGCAGACGCAAACCTGGACAAGGTCCTGAGCGCATACAACAAGCACAGAGACAAG<br>CCGATCAGAGAACAGGCAGAAAACATCATCCACCTGTTCACACTGACAAACCTGGGAGCACCGGCAGCATTCAAGTACTT<br>CGACACAACAATCGACAGAAAGAGATACACAAGCACAAAGGAAGTCCTGGACGCAACACTGATCCACCAGAGCATCACA<br>GGACTGTACGAAACAAGAATCGACCTGAGCCAGCTGGGAGGAGACGGAGGAGGAAGCCCGAAGAAGAAGAGAAAGGTCT<br>AG |
| 508 | ATGGACAAGAAGTACAGCATCGGCCTGGACATCGGCACCAACAGCGTGGGCTGGGCCGTGATCACCGACGAGTACAAGGT<br>GCCCAGCAAGAAGTTCAAGGTGCTGGGCAACACCGACAGACACAGCATCAAGAAGAACCTGATCGGCGCCCTGCTGTTCG<br>ACAGCGGCGAGACCGCCGAGGCCACCAGACTGAAGAGAACCGCCAGAAGAAGATACACCAGAAGAAAGAACAGAATCTG<br>CTACCTGCAGGAGATCTTCAGCAACGAGATGGCCAAGGTGGACGACAGCTTCTTCCACAGACTGGAGGAGAGCTTCCTGGT<br>GGAGGAGGACAAGAAGCACGAGAGACACCCCATCTTCGGCAACATCGTGGACGAGGTGGCCTACCACGAGAAGTACCCC<br>ACCATCTACCACCTGAGAAAGAAGCTGGTGGACAGCACCGACAAGGCCGACCTGAGACTGATCTACCTGGCCCTGGCCCA<br>CATGATCAAGTTCAGAGGCCACTTCCTGATCGAGGGCGACCTGAACCCCGACAACAGCGACGTGGACAAGCTGTTCATCCA<br>GCTGGTGCAGACCTACAACCAGCTGTTCGAGGAGAACCCCATCAACGCCAGCGGCGTGGACGCCAAGGCCATCCTGAGCG<br>CCAGACTGAGCAAGAGCAGAAGACTGGAGAACCTGATCGCCCAGCTGCCCGGCGAGAAGAAGAACGGCCTGTTCGGCAA<br>CCTGATCGCCCTGAGCCTGGGCCTGACCCCCAACTTCAAGAGCAACTTCGACCTGGCCGAGGACGCCAAGCTGCAGCTGAG<br>CAAGGACACCTACGACGACGACCTGGACAACCTGCTGGCCCAGATCGGCGACCAGTACGCCGACCTGTTCCTGGCCGCCA<br>AGAACCTGAGCGACGCCATCCTGCTGAGCGACATCCTGAGAGTGAACACCGAGATCACCAAGGCCCCCCTGAGCGCCAGC<br>ATGATCAAGAGATACGACGAGCACCACCAGGACCTGACCCTGCTGAAGGCCCTGGTGAGACAGCAGCTGCCCGAGAAGTA<br>CAAGGAGATCTTCTTCGACCAGAGCAAGAACGGCTACGCCGGCTACATCGACGGCGGCGCCAGCCAGGAGGAGTTCTACA<br>AGTTCATCAAGCCCATCCTGGAGAAGATGGACGGCACCGAGGAGCTGCTGGTGAAGCTGAACAGAGAGGACCTGCTGAGA<br>AAGCAGAGAACCTTCGACAACGGCAGCATCCCCCACCAGATCCACCTGGGCGAGCTGCACGCCATCCTGAGAAGACAGGA<br>GGACTTCTACCCCTTCCTGAAGGACAACAGAGAGAAGATCGAGAAGATCCTGACCTTCAGAATCCCCTACTACGTGGGCCC<br>CCTGGCCAGAGGCAACAGCAGATTCGCCTGGATGACCAGAAAGAGCGAGGAGACCATCACCCCCTGGAACTTCGAGGAGG<br>TGGTGGACAAGGGCGCCAGCGCCCAGAGCTTCATCGAGAGAATGACCAACTTCGACAAGAACCTGCCCAACGAGAAGGTG<br>CTGCCCAAGCACAGCCTGCTGTACGAGTACTTCACCGTGTACAACGAGCTGACCAAGGTGAAGTACGTGACCGAGGGCAT<br>GAGAAAGCCCGCCTTCCTGAGCGGCGAGCAGAAGAAGGCCATCGTGGACCTGCTGTTCAAGACCAACAGAAAGGTGACCG<br>TGAAGCAGCTGAAGGAGGACTACTTCAAGAAGATCGAGTGCTTCGACAGCGTGGAGATCAGCGGCGTGGAGGACAGATTC<br>AACGCCAGCCTGGGCACCTACCACGACCTGCTGAAGATCATCAAGGACAAGGACTTCCTGGACAACGAGGAGAACGAGGA<br>CATCCTGGAGGACATCGTGCTGACCCTGACCCTGTTCGAGGACAGAGAGATGATCGAGGAGAGACTGAAGACCTACGCCC<br>ACCTGTTCGACGACAAGGTGATGAAGCAGCTGAAGAGAAGAAGATACACCGGCTGGGGCAGACTGAGCAGAAAGCTGAT<br>CAACGGCATCAGAGACAAGCAGAGCGGCAAGACCATCCTGGACTTCCTGAAGAGCGACGGCTTCGCCAACAGAAACTTCA<br>TGCAGCTGATCCACGACGACAGCCTGACCTTCAAGGAGGACATCCAGAAGGCCCAGGTGAGCGGCCAGGGCGACAGCCTG<br>CACGAGCACATCGCCAACCTGGCCGGCAGCCCCGCCATCAAGAAGGGCATCCTGCAGACCGTGAAGGTGGTGGACGAGCT<br>GGTGAAGGTGATGGGCAGACACAAGCCCGAGAACATCGTGATCGAGATGGCCAGAGAGAACCAGACCACCCAGAAGGGC<br>CAGAAGAACAGCAGAGAGAGAATGAAGAGAATCGAGGAGGGCATCAAGGAGCTGGGCAGCCAGATCCTGAAGGAGCACC<br>CCGTGGAGAACACCCAGCTGCAGAACGAGAAGCTGTACCTGTACTACCTGCAGAACGGCAGAGACATGTACGTGGACCAG<br>GAGCTGGACATCAACAGACTGAGCGACTACGACGTGGACCACATCGTGCCCCAGAGCTTCCTGAAGGACGACAGCATCGA<br>CAACAAGGTGCTGACCAGAAGCGACAAGAACAGAGGCAAGAGCGACAACGTGCCCAGCGAGGAGGTGGTGAAGAAGATG<br>AAGAACTACTGGAGACAGCTGCTGAACGCCAAGCTGATCACCCAGAGAAAGTTCGACAACCTGACCAAGGCCGAGAGAGG<br>CGGCCTGAGCGAGCTGGACAAGGCCGGCTTCATCAAGAGACAGCTGGTGGAGACCAGACAGATCACCAAGCACGTGGCCC<br>AGATCCTGGACAGCAGAATGAACACCAAGTACGACGAGAACGACAAGCTGATCAGAGAGGTGAAGGTGATCACCCTGAA<br>GAGCAAGCTGGTGAGCGACTTCAGAAAGGACTTCCAGTTCTACAAGGTGAGAGAGATCAACAACTACCACCACGCCCACG<br>ACGCCTACCTGAACGCCGTGGTGGGCACCGCCCTGATCAAGAAGTACCCCAAGCTGGAGAGCGAGTTCGTGTACGGCGAC<br>TACAAGGTGTACGACGTGAGAAAGATGATCGCCAAGAGCGAGCAGGAGATCGGCAAGGCCACCGCCAAGTACTTCTTCTA<br>CAGCAACATCATGAACTTCTTCAAGACCGAGATCACCCTGGCCAACGGCGAGATCAGAAAGAGACCCCTGATCGAGACCA<br>ACGGCGAGACCGGCGAGATCGTGTGGGACAAGGGCAGAGACTTCGCCACCGTGAGAAAGGTGCTGAGCATGCCCCAGGTG<br>AACATCGTGAAGAAGACCGAGGTGCAGACCGGCGGCTTCAGCAAGGAGAGCATCCTGCCCAAGAGAAACAGCGACAAGC<br>TGATCGCCAGAAAGAAGGACTGGGACCCCAAGAAGTACGGCGGCTTCGACAGCCCCACCGTGGCCTACAGCGTGCTGGTG<br>GTGGCCAAGGTGGAGAAGGGCAAGAGCAAGAAGCTGAAGAGCGTGAAGGAGCTGCTGGGCATCACCATCATGGAGAGAA<br>GCAGCTTCGAGAAGAACCCCATCGACTTCCTGGAGGCCAAGGGCTACAAGGAGGTGAAGAAGGACCTGATCATCAAGCTG<br>CCCAAGTACAGCCTGTTCGAGCTGGAGAACGGCAGAAAGAGAATGCTGGCCAGCGCCGGCGAGCTGCAGAAGGGCAACG<br>AGCTGGCCCTGCCCAGCAAGTACGTGAACTTCCTGTACCTGGCCAGCCACTACGAGAAGCTGAAGGGCAGCCCCGAGGAC<br>AACGAGCAGAAGCAGCTGTTCGTGGAGCAGCACAAGCACTACCTGGACGAGATCATCGAGCAGATCAGCGAGTTCAGCAA<br>GAGAGTGATCCTGGCCGACGCCAACCTGGACAAGGTGCTGAGCGCCTACAACAAGCACAGAGACAAGCCCATCAGAGAGC<br>AGGCCGAGAACATCATCCACCTGTTCACCCTGACCAACCTGGGCGCCCCCGCCGCCTTCAAGTACTTCGACACCACCATCG<br>ACAGAAAGAGATACACCAGCACCAAGGAGGTGCTGGACGCCACCCTGATCCACCAGAGCATCACCGGCCTGTACGAGACC<br>AGAATCGACCTGAGCCAGCTGGGCGGCGACGGCGGCGGCAGCCCCAAGAAGAAGAGAAAGGTGTGA |
| 509 | GGGTCCCGCAGTCGGCGTCCAGCGGCTCTGCTTGTTCGTGTGTGTGTCGTTGCAGGCCTTATTCGGATCCGCCACCATGGAC<br>AAGAAGTACAGCATCGGCCTGGACATCGGCACCAACAGCGTGGGCTGGGCCGTGATCACCGACGAGTACAAGGTGCCCAG<br>CAAGAAGTTCAAGGTGCTGGGCAACACCGACAGACACAGCATCAAGAAGAACCTGATCGGCGCCCTGCTGTTCGACAGCG<br>GCGAGACCGCCGAGGCCACCAGACTGAAGAGAACCGCCAGAAGAAGATACACCAGAAGAAAGAACAGAATCTGCTACCT<br>GCAGGAGATCTTCAGCAACGAGATGGCCAAGGTGGACGACAGCTTCTTCCACAGACTGGAGGAGAGCTTCCTGGTGGAGG<br>AGGACAAGAAGCACGAGAGACACCCCATCTTCGGCAACATCGTGGACGAGGTGGCCTACCACGAGAAGTACCCCACCATC<br>TACCACCTGAGAAAGAAGCTGGTGGACAGCACCGACAAGGCCGACCTGAGACTGATCTACCTGGCCCTGGCCCACATGAT<br>CAAGTTCAGAGGCCACTTCCTGATCGAGGGCGACCTGAACCCCGACAACAGCGACGTGGACAAGCTGTTCATCCAGCTGGT<br>GCAGACCTACAACCAGCTGTTCGAGGAGAACCCCATCAACGCCAGCGGCGTGGACGCCAAGGCCATCCTGAGCGCCAGAC<br>TGAGCAAGAGCAGAAGACTGGAGAACCTGATCGCCCAGCTGCCCGGCGAGAAGAAGAACGGCCTGTTCGGCAACCTGATC<br>GCCCTGAGCCTGGGCCTGACCCCCAACTTCAAGAGCAACTTCGACCTGGCCGAGGACGCCAAGCTGCAGCTGAGCAAGGA<br>CACCTACGACGACGACCTGGACAACCTGCTGGCCCAGATCGGCGACCAGTACGCCGACCTGTTCCTGGCCGCCAAGAACCT<br>GAGCGACGCCATCCTGCTGAGCGACATCCTGAGAGTGAACACCGAGATCACCAAGGCCCCCCTGAGCGCCAGCATGATCA<br>AGAGATACGACGAGCACCACCAGGACCTGACCCTGCTGAAGGCCCTGGTGAGACAGCAGCTGCCCGAGAAGTACAAGGA<br>GATCTTCTTCGACCAGAGCAAGAACGGCTACGCCGGCTACATCGACGGCGGCGCCAGCCAGGAGGAGTTCTACAAGTTCAT<br>CAAGCCCATCCTGGAGAAGATGGACGGCACCGAGGAGCTGCTGGTGAAGCTGAACAGAGAGGACCTGCTGAGAAAGCAG |

TABLE 5-continued

| Exemplary Cas9 mRNA Sequences | |
|---|---|
| SEQ ID NO | Sequence |
| | AGAACCTTCGACAACGGCAGCATCCCCCACCAGATCCACCTGGGCGAGCTGCACGCCATCCTGAGAAGACAGGAGGACTT<br>CTACCCCTTCCTGAAGGACAACAGAGAGAAGATCGAGAAGATCCTGACCTTCAGAATCCCCTACTACGTGGGCCCCCTGGC<br>CAGAGGCAACAGCAGATTCGCCTGGATGACCAGAAAGAGCGAGGAGACCATCACCCCCTGGAACTTCGAGGAGGTGGTGG<br>ACAAGGGCGCCAGCGCCCAGAGCTTCATCGAGAGAATGACCAACTTCGACAAGAACCTGCCCAACGAGAAGGTGCTGCCC<br>AAGCACAGCCTGCTGTACGAGTACTTCACCGTGTACAACGAGCTGACCAAGGTGAAGTACGTGACCGAGGGCATGAGAAA<br>GCCCGCCTTCCTGAGCGGCGAGCAGAAGAAGGCCATCGTGGACCTGCTGTTCAAGACCAACAGAAAGGTGACCGTGAAGC<br>AGCTGAAGGAGGACTACTTCAAGAAGATCGAGTGCTTCGACAGCGTGGAGATCAGCGGCGTGGAGGACAGATTCAACGCC<br>AGCCTGGGCACCTACCACGACCTGCTGAAGATCATCAAGGACAAGGACTTCCTGGACAACGAGGAGAACGAGGACATCCT<br>GGAGGACATCGTGCTGACCCTGACCCTGTTCGAGGACAGAGAGATGATCGAGGAGAGACTGAAGACCTACGCCCACCTGT<br>TCGACGACAAGGTGATGAAGCAGCTGAAGAGAAGAAGATACACCGGCTGGGGCAGACTGAGCAGAAAGCTGATCAACGG<br>CATCAGAGACAAGCAGAGCGGCAAGACCATCCTGGACTTCCTGAAGAGCGACGGCTTCGCCAACAGAAACTTCATGCAGC<br>TGATCCACGACGACAGCCTGACCTTCAAGGAGGACATCCAGAAGGCCCAGGTGAGCGGCCAGGGCGACAGCCTGCACGAG<br>CACATCGCCAACCTGGCCGGCAGCCCCGCCATCAAGAAGGGCATCCTGCAGACCGTGAAGGTGGTGGACGAGCTGGTGAA<br>GGTGATGGGCAGACACAAGCCCGAGAACATCGTGATCGAGATGGCCAGAGAGAACCAGACCACCCAGAAGGGCCAGAAG<br>AACAGCAGAGAGAGAATGAAGAGAATCGAGGAGGGCATCAAGGAGCTGGGCAGCCAGATCCTGAAGGAGCACCCCGTGG<br>AGAACACCCAGCTGCAGAACGAGAAGCTGTACCTGTACTACCTGCAGAACGGCAGAGACATGTACGTGGACCAGGAGCTG<br>GACATCAACAGACTGAGCGACTACGACGTGGACCACATCGTGCCCCAGAGCTTCCTGAAGGACGACAGCATCGACAACAA<br>GGTGCTGACCAGAAGCGACAAGAACAGAGGCAAGAGCGACAACGTGCCCAGCGAGGAGGTGGTGAAGAAGATGAAGAAC<br>TACTGGAGACAGCTGCTGAACGCCAAGCTGATCACCCAGAGAAAGTTCGACAACCTGACCAAGGCCGAGAGAGGCGGCCT<br>GAGCGAGCTGGACAAGGCCGGCTTCATCAAGAGACAGCTGGTGGAGACCAGACAGATCACCAAGCACGTGGCCCAGATCC<br>TGGACAGCAGAATGAACACCAAGTACGACGAGAACGACAAGCTGATCAGAGAGGTGAAGGTGATCACCCTGAAGAGCAA<br>GCTGGTGAGCGACTTCAGAAAGGACTTCCAGTTCTACAAGGTGAGAGAGATCAACAACTACCACCACGCCCACGACGCCT<br>ACCTGAACGCCGTGGTGGGCACCGCCCTGATCAAGAAGTACCCCAAGCTGGAGAGCGAGTTCGTGTACGGCGACTACAAG<br>GTGTACGACGTGAGAAAGATGATCGCCAAGAGCGAGCAGGAGATCGGCAAGGCCACCGCCAAGTACTTCTTCTACAGCAA<br>CATCATGAACTTCTTCAAGACCGAGATCACCCTGGCCAACGGCGAGATCAGAAAGAGACCCCTGATCGAGACCAACGGCG<br>AGACCGGCGAGATCGTGTGGGACAAGGGCAGAGACTTCGCCACCGTGAGAAAGGTGCTGAGCATGCCCCAGGTGAACATC<br>GTGAAGAAGACCGAGGTGCAGACCGGCGGCTTCAGCAAGGAGAGCATCCTGCCCAAGAGAAACAGCGACAAGCTGATCG<br>CCAGAAAGAAGGACTGGGACCCCAAGAAGTACGGCGGCTTCGACAGCCCCACCGTGGCCTACAGCGTGCTGGTGGTGGCC<br>AAGGTGGAGAAGGGCAAGAGCAAGAAGCTGAAGAGCGTGAAGGAGCTGCTGGGCATCACCATCATGGAGAGAAGCAGCT<br>TCGAGAAGAACCCCATCGACTTCCTGGAGGCCAAGGGCTACAAGGAGGTGAAGAAGGACCTGATCATCAAGCTGCCCAAG<br>TACAGCCTGTTCGAGCTGGAGAACGGCAGAAAGAGAATGCTGGCCAGCGCCGGCGAGCTGCAGAAGGGCAACGAGCTGG<br>CCCTGCCCAGCAAGTACGTGAACTTCCTGTACCTGGCCAGCCACTACGAGAAGCTGAAGGGCAGCCCCGAGGACAACGAG<br>CAGAAGCAGCTGTTCGTGGAGCAGCACAAGCACTACCTGGACGAGATCATCGAGCAGATCAGCGAGTTCAGCAAGAGAGT<br>GATCCTGGCCGACGCCAACCTGGACAAGGTGCTGAGCGCCTACAACAAGCACAGAGACAAGCCCATCAGAGAGCAGGCCG<br>AGAACATCATCCACCTGTTCACCCTGACCAACCTGGGCGCCCCCGCCGCCTTCAAGTACTTCGACACCACCATCGACAGAA<br>AGAGATACACCAGCACCAAGGAGGTGCTGGACGCCACCCTGATCCACCAGAGCATCACCGGCCTGTACGAGACCAGAATC<br>GACCTGAGCCAGCTGGGCGGCGACGGCGGCGGCAGCCCCAAGAAGAAGAGAAAGGTGTGACTAGCCATCACATTTAAAA<br>GCATCTCAGCCTACCATGAGAATAAGAGAAAGAAAATGAAGATCAATAGCTTATTCATCTCTTTTTCTTTTTCGTTGGTGTA<br>AAGCCAACACCCTGTCTAAAAAACATAAATTTCTTTAATCATTTTGCCTCTTTTCTCTGTGCTTCAATTAATAAAAAATGGA<br>AAGAACCTCGAG |
| 510 | ATGGACAAGAAGTACTCTATCGGTTTGGACATCGGTACCAACTCTGTCGGTTGGGCCGTCATCACCGACGAATACAAGGTC<br>CCATCTAAGAAGTTCAAGGTCTTGGGTAACACCGACAGACACTCTATCAAGAAGAACTTGATCGGTGCCTTGTTGTTCGAC<br>TCTGGTGAAACCGCCGAAGCCACCAGATTGAAGAGAACCGCCAGAAGAAGATACACCAGAAGAAAGAACAGAATCTGCT<br>ACTTGCAAGAAATCTTCTCTAACGAAATGGCCAAGGTCGACGACTCTTTCTTCCACAGATTGGAAGAATCTTTCTTGGTCGA<br>AGAAGACAAGAAGCACGAAAGACACCCAATCTTCGGTAACATCGTCGACGAAGTCGCCTACCACGAAAAGTACCCAACCA<br>TCTACCACTTGAGAAAGAAGTTGGTCGACTCTACCGACAAGGCCGACTTGAGATTGATCTACTTGGCCTTGGCCCACATGA<br>TCAAGTTCAGAGGTCACTTCTTGATCGAAGGTGACTTGAACCCAGACAACTCTGACGTCGACAAGTTGTTCATCCAATTGGT<br>CCAAACCTACAACCAATTGTTCGAAGAAAACCCAATCAACGCCTCTGGTGTCGACGCCAAGGCCATCTTGTCTGCCAGATT<br>GTCTAAGAGCAGAAGATTGGAAAACTTGATCGCCCAATTGCCAGGTGAAAAGAAGAACGGTTTGTTCGGTAACTTGATCGC<br>CTTGTCTTTGGGTTTGACCCCAAACTTCAAGTCTAACTTCGACTTGGCCGAAGACGCCAAGTTGCAATTGTCTAAGGACACC<br>TACGACGACGACTTGGACAACTTGTTGGCCCAAATCGGTGACCAATACGCCGACTTGTTCTTGGCCGCCAAGAACTTGTCT<br>GACGCCATCTTGTTGTCTGACATCTTGAGAGTCAACACCGAAATCACCAAGGCCCCATTGTCTGCCTCTATGATCAAGAGAT<br>ACGACGAACACCACCAAGACTTGACCTTGTTGAAGGCCTTGGTCAGACAACAATTGCCAGAAAAGTACAAGGAAATCTTCT<br>TCGACCAATCTAAGAACGGTTACGCCGGTTACATCGACGGTGGTGCCTCTCAAGAAGAATTCTACAAGTTCATCAAGCCAA<br>TCTTGGAAAAGATGGACGGTACCGAAGAATTGTTGGTCAAGTTGAACAGAGAAGACTTGTTGAGAAAGCAAAGAACCTTC<br>GACAACGGTTCTATCCCACACCAAATCCACTTGGGTGAATTGCACGCCATCTTGAGAAGACAAGAAGACTTCTACCCATTC<br>TTGAAGGACAACAGAGAAAAGATCGAAAAGATCTTGACCTTCAGAATCCCATACTACGTCGGTCCATTGGCCAGAGGTAA<br>CAGCAGATTCGCCTGGATGACCAGAAAGTCTGAAGAAACCATCACCCCATGGAACTTCGAAGAAGTCGTCGACAAGGGTG<br>CCTCTGCCCAATCTTTCATCGAAAGAATGACCAACTTCGACAAGAACTTGCCAAACGAAAAGGTCTTGCCAAAGCACTCTT<br>TGTTGTACGAATACTTCACCGTCTACAACGAATTGACCAAGGTCAAGTACGTCACCGAAGGTATGAGAAAGCCAGCCTTCT<br>TGTCTGGTGAACAAAAGAAGGCCATCGTCGACTTGTTGTTCAAGACCAACAGAAAGGTCACCGTCAAGCAATTGAAGGAA<br>GACTACTTCAAGAAGATCGAATGCTTCGACTCTGTCGAAATCTCTGGTGTCGAAGACAGATTCAACGCCTCTTTGGGTACCT<br>ACCACGACTTGTTGAAGATCATCAAGGACAAGGACTTCTTGGACAACGAAGAAAACGAAGACATCTTGGAAGACATCGTC<br>TTGACCTTGACCTTGTTCGAAGACAGAGAAATGATCGAAGAAAGATTGAAGACCTACGCCCACTTGTTCGACGACAAGGTC<br>ATGAAGCAATTGAAGAGAAGAAGATACACCGGTTGGGGTAGATTGAGCAGAAAGTTGATCAACGGTATCAGAGACAAGC<br>AATCTGGTAAGACCATCTTGGACTTCTTGAAGTCTGACGGTTTCGCCAACAGAAACTTCATGCAATTGATCCACGACGACTC<br>TTTGACCTTCAAGGAAGACATCCAAAAGGCCCAAGTCTCTGGTCAAGGTGACTCTTTGCACGAACACATCGCCAACTTGGC<br>CGGTTCTCCAGCCATCAAGAAGGGTATCTTGCAAACCGTCAAGGTCGTCGACGAATTGGTCAAGGTCATGGGTAGACACAA<br>GCCAGAAAACATCGTCATCGAAATGGCCAGAGAAAACCAAACCACCCAAAAGGGTCAAAAGAACAGCAGAGAAAGAATG<br>AAGAGAATCGAAGAAGGTATCAAGGAATTGGGTTCTCAAATCTTGAAGGAACACCCAGTCGAAAACACCCAATTGCAAAA<br>CGAAAAGTTGTACTTGTACTACTTGCAAAACGGTAGAGACATGTACGTCGACCAAGAATTGGACATCAACAGATTGTCTGA<br>CTACGACGTCGACCACATCGTCCCACAATCTTTCTTGAAGGACGACTCTATCGACAACAAGGTCTTGACCAGATCTGACAA<br>GAACAGAGGTAAGTCTGACAACGTCCCATCTGAAGAAGTCGTCAAGAAGATGAAGAACTACTGGAGACAATTGTTGAACG<br>CCAAGTTGATCACCCAAAGAAAGTTCGACAACTTGACCAAGGCCGAAAGAGGTGGTTTGTCTGAATTGGACAAGGCCGGT |

TABLE 5-continued

Exemplary Cas9 mRNA Sequences

| SEQ ID NO | Sequence |
|---|---|
| | TTCATCAAGAGACAATTGGTCGAAACCAGACAAATCACCAAGCACGTCGCCCAAATCTTGGACAGCAGAATGAACACCAA<br>GTACGACGAAAACGACAAGTTGATCAGAGAAGTCAAGGTCATCACCTTGAAGTCTAAGTTGGTCTCTGACTTCAGAAAGG<br>ACTTCCAATTCTACAAGGTCAGAGAAATCAACAACTACCACCACGCCCACGACGCCTACTTGAACGCCGTCGTCGGTACCG<br>CCTTGATCAAGAAGTACCCAAAGTTGGAATCTGAATTCGTCTACGGTGACTACAAGGTCTACGACGTCAGAAAGATGATCG<br>CCAAGTCTGAACAAGAAATCGGTAAGGCCACCGCCAAGTACTTCTTCTACTCTAACATCATGAACTTCTTCAAGACCGAAA<br>TCACCTTGGCCAACGGTGAAATCAGAAAGAGACCATTGATCGAAACCAACGGTGAAACCGGTGAAATCGTCTGGGACAAG<br>GGTAGAGACTTCGCCACCGTCAGAAAGGTCTTGTCTATGCCACAAGTCAACATCGTCAAGAAGACCGAAGTCCAAACCGGT<br>GGTTTCTCTAAGGAATCTATCTTGCCAAAGAGAAACTCTGACAAGTTGATCGCCAGAAAGAAGGACTGGGACCCAAAGAA<br>GTACGGTGGTTTCGACTCTCCAACCGTCGCCTACTCTGTCTTGGTCGTCGCCAAGGTCGAAAAGGGTAAGTCTAAGAAGTT<br>GAAGTCTGTCAAGGAATTGTTGGGTATCACCATCATGGAAAGATCTTCTTTCGAAAAGAACCCAATCGACTTCTTGGAAGC<br>CAAGGGTTACAAGGAAGTCAAGAAGGACTTGATCATCAAGTTGCCAAAGTACTCTTTGTTCGAATTGGAAAACGGTAGAA<br>AGAGAATGTTGGCCTCTGCCGGTGAATTGCAAAAGGGTAACGAATTGGCCTTGCCATCTAAGTACGTCAACTTCTTGTACTT<br>GGCCTCTCACTACGAAAAGTTGAAGGGTTCTCCAGAAGACAACGAACAAAAGCAATTGTTCGTCGAACAACACAAGCACT<br>ACTTGGACGAAATCATCGAACAAATCTCTGAATTCTCTAAGAGAGTCATCTTGGCCGACGCCAACTTGGACAAGGTCTTGT<br>CTGCCTACAACAAGCACAGAGACAAGCCAATCAGAGAACAAGCCGAAAACATCATCCACTTGTTCACCTTGACCAACTTG<br>GGTGCCCCAGCCGCCTTCAAGTACTTCGACACCACCATCGACAGAAAGAGATACACCTCTACCAAGGAAGTCTTGGACGCC<br>ACCTTGATCCACCAATCTATCACCGGTTTGTACGAAACCAGAATCGACTTGTCTCAATTGGGTGGTGACGGTGGTGGTTCTC<br>CAAAGAAGAAGAGAAAGGTCTAA |
| 511 | ATGGACAAGAAGTACTCCATCGGCCTGGACATCGGCACCAACTCCGTGGGCTGGGCCGTGATCACCGACGAGTACAAGGT<br>GCCCTCCAAGAAGTTCAAGGTGCTGGGCAACACCGACCGGCACTCCATCAAGAAGAACCTGATCGGCGCCCTGCTGTTCGA<br>CTCCGGCGAGACCGCCGAGGCCACCCGGCTGAAGCGGACCGCCCGGCGGCGGTACACCCGGCGGAAGAACCGGATCTGCT<br>ACCTGCAGGAGATCTTCTCCAACGAGATGGCCAAGGTGGACGACTCCTTCTTCCACCGGCTGGAGGAGTCCTTCCTGGTGG<br>AGGAGGACAAGAAGCACGAGCGGCACCCCATCTTCGGCAACATCGTGGACGAGGTGGCCTACCACGAGAAGTACCCCACC<br>ATCTACCACCTGCGGAAGAAGCTGGTGGACTCCACCGACAAGGCCGACCTGCGGCTGATCTACCTGGCCCTGGCCCACATG<br>ATCAAGTTCCGGGGCCACTTCCTGATCGAGGGCGACCTGAACCCCGACAACTCCGACGTGGACAAGCTGTTCATCCAGCTG<br>GTGCAGACCTACAACCAGCTGTTCGAGGAGAACCCCATCAACGCCTCCGGCGTGGACGCCAAGGCCATCCTGTCCGCCCGG<br>CTGTCCAAGTCCCGGCGGCTGGAGAACCTGATCGCCCAGCTGCCCGGCGAGAAGAAGAACGGCCTGTTCGGCAACCTGAT<br>CGCCCTGTCCCTGGGCCTGACCCCCAACTTCAAGTCCAACTTCGACCTGGCCGAGGACGCCAAGCTGCAGCTGTCCAAGGA<br>CACCTACGACGACGACCTGGACAACCTGCTGGCCCAGATCGGCGACCAGTACGCCGACCTGTTCCTGGCCGCCAAGAACCT<br>GTCCGACGCCATCCTGCTGTCCGACATCCTGCGGGTGAACACCGAGATCACCAAGGCCCCCCTGTCCGCCTCCATGATCAA<br>GCGGTACGACGAGCACCACCAGGACCTGACCCTGCTGAAGGCCCTGGTGCGGCAGCAGCTGCCCGAGAAGTACAAGGAGA<br>TCTTCTTCGACCAGTCCAAGAACGGCTACGCCGGCTACATCGACGGCGGCGCCTCCCAGGAGGAGTTCTACAAGTTCATCA<br>AGCCCATCCTGGAGAAGATGGACGGCACCGAGGAGCTGCTGGTGAAGCTGAACCGGGAGGACCTGCTGCGGAAGCAGCG<br>GACCTTCGACAACGGCTCCATCCCCCACCAGATCCACCTGGGCGAGCTGCACGCCATCCTGCGGCGGCAGGAGGACTTCTA<br>CCCCTTCCTGAAGGACAACCGGGAGAAGATCGAGAAGATCCTGACCTTCCGGATCCCCTACTACGTGGGCCCCCTGGCCCG<br>GGGCAACTCCCGGTTCGCCTGGATGACCCGGAAGTCCGAGGAGACCATCACCCCCTGGAACTTCGAGGAGGTGGTGGACA<br>AGGGCGCCTCCGCCCAGTCCTTCATCGAGCGGATGACCAACTTCGACAAGAACCTGCCCAACGAGAAGGTGCTGCCCAAG<br>CACTCCCTGCTGTACGAGTACTTCACCGTGTACAACGAGCTGACCAAGGTGAAGTACGTGACCGAGGGCATGCGGAAGCCC<br>GCCTTCCTGTCCGGCGAGCAGAAGAAGGCCATCGTGGACCTGCTGTTCAAGACCAACCGGAAGGTGACCGTGAAGCAGCT<br>GAAGGAGGACTACTTCAAGAAGATCGAGTGCTTCGACTCCGTGGAGATCTCCGGCGTGGAGGACCGGTTCAACGCCTCCCT<br>GGGCACCTACCACGACCTGCTGAAGATCATCAAGGACAAGGACTTCCTGGACAACGAGGAGAACGAGGACATCCTGGAGG<br>ACATCGTGCTGACCCTGACCCTGTTCGAGGACCGGGAGATGATCGAGGAGCGGCTGAAGACCTACGCCCACCTGTTCGACG<br>ACAAGGTGATGAAGCAGCTGAAGCGGCGGCGGTACACCGGCTGGGGCCGGCTGTCCCGGAAGCTGATCAACGGCATCCGG<br>GACAAGCAGTCCGGCAAGACCATCCTGGACTTCCTGAAGTCCGACGGCTTCGCCAACCGGAACTTCATGCAGCTGATCCAC<br>GACGACTCCCTGACCTTCAAGGAGGACATCCAGAAGGCCCAGGTGTCCGGCCAGGGCGACTCCCTGCACGAGCACATCGC<br>CAACCTGGCCGGCTCCCCCGCCATCAAGAAGGGCATCCTGCAGACCGTGAAGGTGGTGGACGAGCTGGTGAAGGTGATGG<br>GCCGGCACAAGCCCGAGAACATCGTGATCGAGATGGCCCGGGAGAACCAGACCACCCAGAAGGGCCAGAAGAACTCCCG<br>GGAGCGGATGAAGCGGATCGAGGAGGGCATCAAGGAGCTGGGCTCCCAGATCCTGAAGGAGCACCCCGTGGAGAACACC<br>CAGCTGCAGAACGAGAAGCTGTACCTGTACTACCTGCAGAACGGCCGGGACATGTACGTGGACCAGGAGCTGGACATCAA<br>CCGGCTGTCCGACTACGACGTGGACCACATCGTGCCCCAGTCCTTCCTGAAGGACGACTCCATCGACAACAAGGTGCTGAC<br>CCGGTCCGACAAGAACCGGGGCAAGTCCGACAACGTGCCCTCCGAGGAGGTGGTGAAGAAGATGAAGAACTACTGGCGGC<br>AGCTGCTGAACGCCAAGCTGATCACCCAGCGGAAGTTCGACAACCTGACCAAGGCCGAGCGGGGCGGCCTGTCCGAGCTG<br>GACAAGGCCGGCTTCATCAAGCGGCAGCTGGTGGAGACCCGGCAGATCACCAAGCACGTGGCCCAGATCCTGGACTCCCG<br>GATGAACACCAAGTACGACGAGAACGACAAGCTGATCCGGGAGGTGAAGGTGATCACCCTGAAGTCCAAGCTGGTGTCCG<br>ACTTCCGGAAGGACTTCCAGTTCTACAAGGTGCGGGAGATCAACAACTACCACCACGCCCACGACGCCTACCTGAACGCCG<br>TGGTGGGCACCGCCCTGATCAAGAAGTACCCCAAGCTGGAGTCCGAGTTCGTGTACGGCGACTACAAGGTGTACGACGTGC<br>GGAAGATGATCGCCAAGTCCGAGCAGGAGATCGGCAAGGCCACCGCCAAGTACTTCTTCTACTCCAACATCATGAACTTCT<br>TCAAGACCGAGATCACCCTGGCCAACGGCGAGATCCGGAAGCGGCCCCTGATCGAGACCAACGGCGAGACCGGCGAGATC<br>GTGTGGGACAAGGGCCGGGACTTCGCCACCGTGCGGAAGGTGCTGTCCATGCCCCAGGTGAACATCGTGAAGAAGACCGA<br>GGTGCAGACCGGCGGCTTCTCCAAGGAGTCCATCCTGCCCAAGCGGAACTCCGACAAGCTGATCGCCCGGAAGAAGGACT<br>GGGACCCCAAGAAGTACGGCGGCTTCGACTCCCCCACCGTGGCCTACTCCGTGCTGGTGGTGGCCAAGGTGGAGAAGGGC<br>AAGTCCAAGAAGCTGAAGTCCGTGAAGGAGCTGCTGGGCATCACCATCATGGAGCGGTCCTCCTTCGAGAAGAACCCCAT<br>CGACTTCCTGGAGGCCAAGGGCTACAAGGAGGTGAAGAAGGACCTGATCATCAAGCTGCCCAAGTACTCCCTGTTCGAGCT<br>GGAGAACGGCCGGAAGCGGATGCTGGCCTCCGCCGGCGAGCTGCAGAAGGGCAACGAGCTGGCCCTGCCCTCCAAGTACG<br>TGAACTTCCTGTACCTGGCCTCCCACTACGAGAAGCTGAAGGGCTCCCCCGAGGACAACGAGCAGAAGCAGCTGTTCGTGG<br>AGCAGCACAAGCACTACCTGGACGAGATCATCGAGCAGATCTCCGAGTTCTCCAAGCGGGTGATCCTGGCCGACGCCAAC<br>CTGGACAAGGTGCTGTCCGCCTACAACAAGCACCGGGACAAGCCCATCCGGGAGCAGGCCGAGAACATCATCCACCTGTT<br>CACCCTGACCAACCTGGGCGCCCCCGCCGCCTTCAAGTACTTCGACACCACCATCGACCGGAAGCGGTACACCTCCACCAA<br>GGAGGTGCTGGACGCCACCCTGATCCACCAGTCCATCACCGGCCTGTACGAGACCCGGATCGACCTGTCCCAGCTGGGCGG<br>CGACGGCGGCGGCTCCCCCAAGAAGAAGCGGAAGGTGTGA |
| 512 | ATGGACAAGAAGTACAGCATCGGCCTGGACATCGGCACCAACAGCGTGGGCTGGGCCGTGATCACCGACGAGTACAAGGT<br>GCCCAGCAAGAAGTTCAAGGTGCTGGGCAACACCGACCGGCACAGCATCAAGAAGAACCTGATCGGCGCCCTGCTGTTCG<br>ACAGCGGCGAGACCGCCGAGGCCACCCGGCTGAAGCGGACCGCCCGGCGGCGGTACACCCGGCGGAAGAACCGGATCTG |

TABLE 5-continued

Exemplary Cas9 mRNA Sequences

| SEQ ID NO | Sequence |
|---|---|
| | CTACCTGCAGGAGATCTTCAGCAACGAGATGGCCAAGGTGGACGACAGCTTCTTCCACCGGCTGGAGGAGAGCTTCCTGGT |
| | GGAGGAGGACAAGAAGCACGAGCGGCACCCCATCTTCGGCAACATCGTGGACGAGGTGGCCTACCACGAGAAGTACCCCA |
| | CCATCTACCACCTGCGGAAGAAGCTGGTGGACAGCACCGACAAGGCCGACCTGCGGCTGATCTACCTGGCCCTGGCCCAC |
| | ATGATCAAGTTCCGGGGCCACTTCCTGATCGAGGGCGACCTGAACCCCGACAACAGCGACGTGGACAAGCTGTTCATCCAG |
| | CTGGTGCAGACCTACAACCAGCTGTTCGAGGAGAACCCCATCAACGCCAGCGGCGTGGACGCCAAGGCCATCCTGAGCGC |
| | CCGGCTGAGCAAGAGCCGGCGGCTGGAGAACCTGATCGCCCAGCTGCCCGGCGAGAAGAAGAACGGCCTGTTCGGCAACC |
| | TGATCGCCCTGAGCCTGGGCCTGACCCCCAACTTCAAGAGCAACTTCGACCTGGCCGAGGACGCCAAGCTGCAGCTGAGCA |
| | AGGACACCTACGACGACGACCTGGACAACCTGCTGGCCCAGATCGGCGACCAGTACGCCGACCTGTTCCTGGCCGCCAAG |
| | AACCTGAGCGACGCCATCCTGCTGAGCGACATCCTGCGGGTGAACACCGAGATCACCAAGGCCCCCCTGAGCGCCAGCAT |
| | GATCAAGCGGTACGACGAGCACCACCAGGACCTGACCCTGCTGAAGGCCCTGGTGCGGCAGCAGCTGCCCGAGAAGTACA |
| | AGGAGATCTTCTTCGACCAGAGCAAGAACGGCTACGCCGGCTACATCGACGGCGGCGCCAGCCAGGAGGAGTTCTACAAG |
| | TTCATCAAGCCCATCCTGGAGAAGATGGACGGCACCGAGGAGCTGCTGGTGAAGCTGAACCGGGAGGACCTGCTGCGGAA |
| | GCAGCGGACCTTCGACAACGGCAGCATCCCCCACCAGATCCACCTGGGCGAGCTGCACGCCATCCTGCGGCGGCAGGAGG |
| | ACTTCTACCCCTTCCTGAAGGACAACCGGGAGAAGATCGAGAAGATCCTGACCTTCCGGATCCCCTACTACGTGGGCCCCC |
| | TGGCCCGGGGCAACAGCCGGTTCGCCTGGATGACCCGGAAGAGCGAGGAGACCATCACCCCCTGGAACTTCGAGGAGGTG |
| | GTGGACAAGGGCGCCAGCGCCCAGAGCTTCATCGAGCGGATGACCAACTTCGACAAGAACCTGCCCAACGAGAAGGTGCT |
| | GCCCAAGCACAGCCTGCTGTACGAGTACTTCACCGTGTACAACGAGCTGACCAAGGTGAAGTACGTGACCGAGGGCATGC |
| | GGAAGCCCGCCTTCCTGAGCGGCGAGCAGAAGAAGGCCATCGTGGACCTGCTGTTCAAGACCAACCGGAAGGTGACCGTG |
| | AAGCAGCTGAAGGAGGACTACTTCAAGAAGATCGAGTGCTTCGACAGCGTGGAGATCAGCGGCGTGGAGGACCGGTTCAA |
| | CGCCAGCCTGGGCACCTACCACGACCTGCTGAAGATCATCAAGGACAAGGACTTCCTGGACAACGAGGAGAACGAGGACA |
| | TCCTGGAGGACATCGTGCTGACCCTGACCCTGTTCGAGGACCGGGAGATGATCGAGGAGCGGCTGAAGACCTACGCCCAC |
| | CTGTTCGACGACAAGGTGATGAAGCAGCTGAAGCGGCGGCGGTACACCGGCTGGGGCCGGCTGAGCCGGAAGCTGATCAA |
| | CGGCATCCGGGACAAGCAGAGCGGCAAGACCATCCTGGACTTCCTGAAGAGCGACGGCTTCGCCAACCGGAACTTCATGC |
| | AGCTGATCCACGACGACAGCCTGACCTTCAAGGAGGACATCCAGAAGGCCCAGGTGAGCGGCCAGGGCGACAGCCTGCAC |
| | GAGCACATCGCCAACCTGGCCGGCAGCCCCGCCATCAAGAAGGGCATCCTGCAGACCGTGAAGGTGGTGGACGAGCTGGT |
| | GAAGGTGATGGGCCGGCACAAGCCCGAGAACATCGTGATCGAGATGGCCCGGGAGAACCAGACCACCCAGAAGGGCCAG |
| | AAGAACAGCCGGGAGCGGATGAAGCGGATCGAGGAGGGCATCAAGGAGCTGGGCAGCCAGATCCTGAAGGAGCACCCCG |
| | TGGAGAACACCCAGCTGCAGAACGAGAAGCTGTACCTGTACTACCTGCAGAACGGCCGGGACATGTACGTGGACCAGGAG |
| | CTGGACATCAACCGGCTGAGCGACTACGACGTGGACCACATCGTGCCCCAGAGCTTCCTGAAGGACGACAGCATCGACAA |
| | CAAGGTGCTGACCCGGAGCGACAAGAACCGGGGCAAGAGCGACAACGTGCCCAGCGAGGAGGTGGTGAAGAAGATGAAG |
| | AACTACTGGCGGCAGCTGCTGAACGCCAAGCTGATCACCCAGCGGAAGTTCGACAACCTGACCAAGGCCGAGCGGGGCGG |
| | CCTGAGCGAGCTGGACAAGGCCGGCTTCATCAAGCGGCAGCTGGTGGAGACCCGGCAGATCACCAAGCACGTGGCCCAGA |
| | TCCTGGACAGCCGGATGAACACCAAGTACGACGAGAACGACAAGCTGATCCGGGAGGTGAAGGTGATCACCCTGAAGAGC |
| | AAGCTGGTGAGCGACTTCCGGAAGGACTTCCAGTTCTACAAGGTGCGGGAGATCAACAACTACCACCACGCCCACGACGC |
| | CTACCTGAACGCCGTGGTGGGCACCGCCCTGATCAAGAAGTACCCCAAGCTGGAGAGCGAGTTCGTGTACGGCGACTACA |
| | AGGTGTACGACGTGCGGAAGATGATCGCCAAGAGCGAGCAGGAGATCGGCAAGGCCACCGCCAAGTACTTCTTCTACAGC |
| | AACATCATGAACTTCTTCAAGACCGAGATCACCCTGGCCAACGGCGAGATCCGGAAGCGGCCCCTGATCGAGACCAACGG |
| | CGAGACCGGCGAGATCGTGTGGGACAAGGGCCGGGACTTCGCCACCGTGCGGAAGGTGCTGAGCATGCCCCAGGTGAACA |
| | TCGTGAAGAAGACCGAGGTGCAGACCGGCGGCTTCAGCAAGGAGAGCATCCTGCCCAAGCGGAACAGCGACAAGCTGATC |
| | GCCCGGAAGAAGGACTGGGACCCCAAGAAGTACGGCGGCTTCGACAGCCCCACCGTGGCCTACAGCGTGCTGGTGGTGGC |
| | CAAGGTGGAGAAGGGCAAGAGCAAGAAGCTGAAGAGCGTGAAGGAGCTGCTGGGCATCACCATCATGGAGCGGAGCAGC |
| | TTCGAGAAGAACCCCATCGACTTCCTGGAGGCCAAGGGCTACAAGGAGGTGAAGAAGGACCTGATCATCAAGCTGCCCAA |
| | GTACAGCCTGTTCGAGCTGGAGAACGGCCGGAAGCGGATGCTGGCCAGCGCCGGCGAGCTGCAGAAGGGCAACGAGCTGG |
| | CCCTGCCCAGCAAGTACGTGAACTTCCTGTACCTGGCCAGCCACTACGAGAAGCTGAAGGGCAGCCCCGAGGACAACGAG |
| | CAGAAGCAGCTGTTCGTGGAGCAGCACAAGCACTACCTGGACGAGATCATCGAGCAGATCAGCGAGTTCAGCAAGCGGGT |
| | GATCCTGGCCGACGCCAACCTGGACAAGGTGCTGAGCGCCTACAACAAGCACCGGGACAAGCCCATCCGGGAGCAGGCCG |
| | AGAACATCATCCACCTGTTCACCCTGACCAACCTGGGCGCCCCCGCCGCCTTCAAGTACTTCGACACCACCATCGACCGGA |
| | AGCGGTACACCAGCACCAAGGAGGTGCTGGACGCCACCCTGATCCACCAGAGCATCACCGGCCTGTACGAGACCCGGATC |
| | GACCTGAGCCAGCTGGGCGGCGACGGCGGCGGCAGCCCCAAGAAGAAGCGGAAGGTGTGA |
| 513 | ATGGACAAGAAGTACTCCATCGGCCTGGACATCGGCACCAACTCCGTGGGCTGGGCCGTGATCACCGACGAGTACAAGGT |
| | GCCCTCCAAGAAGTTCAAGGTGCTGGGCAACACCGACCGGCACTCCATCAAGAAGAACCTGATCGGCGCCCTGCTGTTCGA |
| | CTCCGGCGAGACCGCCGAGGCCACCCGGCTGAAGCGGACCGCCCGGCGGCGGTACACCCGGCGGAAGAACCGGATCTGCT |
| | ACCTGCAGGAGATCTTCTCCAACGAGATGGCCAAGGTGGACGACTCCTTCTTCCACCGGCTGGAGGAGTCCTTCCTGGTGG |
| | AGGAGGACAAGAAGCACGAGCGGCACCCCATCTTCGGCAACATCGTGGACGAGGTGGCCTACCACGAGAAGTACCCCACC |
| | ATCTACCACCTGCGGAAGAAGCTGGTGGACTCCACCGACAAGGCCGACCTGCGGCTGATCTACCTGGCCCTGGCCCACATG |
| | ATCAAGTTCCGGGGCCACTTCCTGATCGAGGGCGACCTGAACCCCGACAACTCCGACGTGGACAAGCTGTTCATCCAGCTG |
| | GTGCAGACCTACAACCAGCTGTTCGAGGAGAACCCCATCAACGCCTCCGGCGTGGACGCCAAGGCCATCCTGTCCGCCCGG |
| | CTGTCCAAGTCCCGGCGGCTGGAGAACCTGATCGCCCAGCTGCCCGGCGAGAAGAAGAACGGCCTGTTCGGCAACCTGAT |
| | CGCCCTGTCCCTGGGCCTGACCCCCAACTTCAAGTCCAACTTCGACCTGGCCGAGGACGCCAAGCTGCAGCTGTCCAAGGA |
| | CACCTACGACGACGACCTGGACAACCTGCTGGCCCAGATCGGCGACCAGTACGCCGACCTGTTCCTGGCCGCCAAGAACCT |
| | GTCCGACGCCATCCTGCTGTCCGACATCCTGCGGGTGAACACCGAGATCACCAAGGCCCCCCTGTCCGCCTCCATGATCAA |
| | GCGGTACGACGAGCACCACCAGGACCTGACCCTGCTGAAGGCCCTGGTGCGGCAGCAGCTGCCCGAGAAGTACAAGGAGA |
| | TCTTCTTCGACCAGTCCAAGAACGGCTACGCCGGCTACATCGACGGCGGCGCCTCCCAGGAGGAGTTCTACAAGTTCATCA |
| | AGCCCATCCTGGAGAAGATGGACGGCACCGAGGAGCTGCTGGTGAAGCTGAACCGGGAGGACCTGCTGCGGAAGCAGCG |
| | GACCTTCGACAACGGCTCCATCCCCCACCAGATCCACCTGGGCGAGCTGCACGCCATCCTGCGGCGGCAGGAGGACTTCTA |
| | CCCCTTCCTGAAGGACAACCGGGAGAAGATCGAGAAGATCCTGACCTTCCGGATCCCCTACTACGTGGGCCCCCTGGCCCG |
| | GGGCAACTCCCGGTTCGCCTGGATGACCCGGAAGTCCGAGGAGACCATCACCCCCTGGAACTTCGAGGAGGTGGTGGACA |
| | AGGGCGCCTCCGCCCAGTCCTTCATCGAGCGGATGACCAACTTCGACAAGAACCTGCCCAACGAGAAGGTGCTGCCCAAG |
| | CACTCCCTGCTGTACGAGTACTTCACCGTGTACAACGAGCTGACCAAGGTGAAGTACGTGACCGAGGGCATGCGGAAGCCC |
| | GCCTTCCTGTCCGGCGAGCAGAAGAAGGCCATCGTGGACCTGCTGTTCAAGACCAACCGGAAGGTGACCGTGAAGCAGCT |
| | GAAGGAGGACTACTTCAAGAAGATCGAGTGCTTCGACTCCGTGGAGATCTCCGGCGTGGAGGACCGGTTCAACGCCTCCCT |
| | GGGCACCTACCACGACCTGCTGAAGATCATCAAGGACAAGGACTTCCTGGACAACGAGGAGAACGAGGACATCCTGGAGG |
| | ACATCGTGCTGACCCTGACCCTGTTCGAGGACCGGGAGATGATCGAGGAGCGGCTGAAGACCTACGCCCACCTGTTCGACG |
| | ACAAGGTGATGAAGCAGCTGAAGCGGCGGCGGTACACCGGCTGGGGCCGGCTGTCCCGGAAGCTGATCAACGGCATCCGG |

TABLE 5-continued

Exemplary Cas9 mRNA Sequences

| SEQ ID NO | Sequence |
|---|---|
| | GACAAGCAGTCCGGCAAGACCATCCTGGACTTCCTGAAGTCCGACGGCTTCGCCAACCGGAACTTCATGCAGCTGATCCAC<br>GACGACTCCCTGACCTTCAAGGAGGACATCCAGAAGGCCCAGGTGTCCGGCCAGGGCGACTCCCTGCACGAGCACATCGC<br>CAACCTGGCCGGCTCCCCCGCCATCAAGAAGGGCATCCTGCAGACCGTGAAGGTGGTGGACGAGCTGGTGAAGGTGATGG<br>GCCGGCACAAGCCCGAGAACATCGTGATCGAGATGGCCCGGGAGAACCAGACCACCCAGAAGGGCCAGAAGAACTCCCG<br>GGAGCGGATGAAGCGGATCGAGGAGGGCATCAAGGAGCTGGGCTCCCAGATCCTGAAGGAGCACCCCGTGGAGAACACC<br>CAGCTGCAGAACGAGAAGCTGTACCTGTACTACCTGCAGAACGGCCGGGACATGTACGTGGACCAGGAGCTGGACATCAA<br>CCGGCTGTCCGACTACGACGTGGACCACATCGTGCCCCAGTCCTTCCTGAAGGACGACTCCATCGACAACAAGGTGCTGAC<br>CCGGTCCGACAAGAACCGGGGCAAGTCCGACAACGTGCCCTCCGAGGAGGTGGTGAAGAAGATGAAGAACTACTGGCGGC<br>AGCTGCTGAACGCCAAGCTGATCACCCAGCGGAAGTTCGACAACCTGACCAAGGCCGAGCGGGGCGGCCTGTCCGAGCTG<br>GACAAGGCCGGCTTCATCAAGCGGCAGCTGGTGGAGACCCGGCAGATCACCAAGCACGTGGCCCAGATCCTGGACTCCCG<br>GATGAACACCAAGTACGACGAGAACGACAAGCTGATCCGGGAGGTGAAGGTGATCACCCTGAAGTCCAAGCTGGTGTCCG<br>ACTTCCGGAAGGACTTCCAGTTCTACAAGGTGCGGGAGATCAACAACTACCACCACGCCCACGACGCCTACCTGAACGCCG<br>TGGTGGGCACCGCCCTGATCAAGAAGTACCCCAAGCTGGAGTCCGAGTTCGTGTACGGCGACTACAAGGTGTACGACGTGC<br>GGAAGATGATCGCCAAGTCCGAGCAGGAGATCGGCAAGGCCACCGCCAAGTACTTCTTCTACTCCAACATCATGAACTTCT<br>TCAAGACCGAGATCACCCTGGCCAACGGCGAGATCCGGAAGCGGCCCCTGATCGAGACCAACGGCGAGACCGGCGAGATC<br>GTGTGGGACAAGGGCCGGGACTTCGCCACCGTGCGGAAGGTGCTGTCCATGCCCCAGGTGAACATCGTGAAGAAGACCGA<br>GGTGCAGACCGGCGGCTTCTCCAAGGAGTCCATCCTGCCCAAGCGGAACTCCGACAAGCTGATCGCCCGGAAGAAGGACT<br>GGGACCCCAAGAAGTACGGCGGCTTCGACTCCCCCACCGTGGCCTACTCCGTGCTGGTGGTGGCCAAGGTGGAGAAGGGC<br>AAGTCCAAGAAGCTGAAGTCCGTGAAGGAGCTGCTGGGCATCACCATCATGGAGCGGTCCTCCTTCGAGAAGAACCCCAT<br>CGACTTCCTGGAGGCCAAGGGCTACAAGGAGGTGAAGAAGGACCTGATCATCAAGCTGCCCAAGTACTCCCTGTTCGAGCT<br>GGAGAACGGCCGGAAGCGGATGCTGGCCTCCGCCGGCGAGCTGCAGAAGGGCAACGAGCTGGCCCTGCCCTCCAAGTACG<br>TGAACTTCCTGTACCTGGCCTCCCACTACGAGAAGCTGAAGGGCTCCCCCGAGGACAACGAGCAGAAGCAGCTGTTCGTGG<br>AGCAGCACAAGCACTACCTGGACGAGATCATCGAGCAGATCTCCGAGTTCTCCAAGCGGGTGATCCTGGCCGACGCCAAC<br>CTGGACAAGGTGCTGTCCGCCTACAACAAGCACCGGGACAAGCCCATCCGGGAGCAGGCCGAGAACATCATCCACCTGTT<br>CACCCTGACCAACCTGGGCGCCCCCGCCGCCTTCAAGTACTTCGACACCACCATCGACCGGAAGCGGTACACCTCCACCAA<br>GGAGGTGCTGGACGCCACCCTGATCCACCAGTCCATCACCGGCCTGTACGAGACCCGGATCGACCTGTCCCAGCTGGGCGG<br>CGACGGCTCCGGCTCCCCCAAGAAGAAGCGGAAGGTGGACGGCTCCCCCAAGAAGAAGCGGAAGGTGGACTCCGGCTGA |
| 514 | ATGGACAAGAAGTACAGCATCGGCCTGGACATCGGCACCAACAGCGTGGGCTGGGCCGTGATCACCGACGAGTACAAGGT<br>GCCCAGCAAGAAGTTCAAGGTGCTGGGCAACACCGACCGGCACAGCATCAAGAAGAACCTGATCGGCGCCCTGCTGTTCG<br>ACAGCGGCGAGACCGCCGAGGCCACCCGGCTGAAGCGGACCGCCCGGCGGCGGTACACCCGGCGGAAGAACCGGATCTG<br>CTACCTGCAGGAGATCTTCAGCAACGAGATGGCCAAGGTGGACGACAGCTTCTTCCACCGGCTGGAGGAGAGCTTCCTGGT<br>GGAGGAGGACAAGAAGCACGAGCGGCACCCCATCTTCGGCAACATCGTGGACGAGGTGGCCTACCACGAGAAGTACCCCA<br>CCATCTACCACCTGCGGAAGAAGCTGGTGGACAGCACCGACAAGGCCGACCTGCGGCTGATCTACCTGGCCCTGGCCCAC<br>ATGATCAAGTTCCGGGGCCACTTCCTGATCGAGGGCGACCTGAACCCCGACAACAGCGACGTGGACAAGCTGTTCATCCAG<br>CTGGTGCAGACCTACAACCAGCTGTTCGAGGAGAACCCCATCAACGCCAGCGGCGTGGACGCCAAGGCCATCCTGAGCGC<br>CCGGCTGAGCAAGAGCCGGCGGCTGGAGAACCTGATCGCCCAGCTGCCCGGCGAGAAGAAGAACGGCCTGTTCGGCAACC<br>TGATCGCCCTGAGCCTGGGCCTGACCCCCAACTTCAAGAGCAACTTCGACCTGGCCGAGGACGCCAAGCTGCAGCTGAGCA<br>AGGACACCTACGACGACGACCTGGACAACCTGCTGGCCCAGATCGGCGACCAGTACGCCGACCTGTTCCTGGCCGCCAAG<br>AACCTGAGCGACGCCATCCTGCTGAGCGACATCCTGCGGGTGAACACCGAGATCACCAAGGCCCCCCTGAGCGCCAGCAT<br>GATCAAGCGGTACGACGAGCACCACCAGGACCTGACCCTGCTGAAGGCCCTGGTGCGGCAGCAGCTGCCCGAGAAGTACA<br>AGGAGATCTTCTTCGACCAGAGCAAGAACGGCTACGCCGGCTACATCGACGGCGGCGCCAGCCAGGAGGAGTTCTACAAG<br>TTCATCAAGCCCATCCTGGAGAAGATGGACGGCACCGAGGAGCTGCTGGTGAAGCTGAACCGGGAGGACCTGCTGCGGAA<br>GCAGCGGACCTTCGACAACGGCAGCATCCCCCACCAGATCCACCTGGGCGAGCTGCACGCCATCCTGCGGCGGCAGGAGG<br>ACTTCTACCCCTTCCTGAAGGACAACCGGGAGAAGATCGAGAAGATCCTGACCTTCCGGATCCCCTACTACGTGGGCCCCC<br>TGGCCCGGGGCAACAGCCGGTTCGCCTGGATGACCCGGAAGAGCGAGGAGACCATCACCCCCTGGAACTTCGAGGAGGTG<br>GTGGACAAGGGCGCCAGCGCCCAGAGCTTCATCGAGCGGATGACCAACTTCGACAAGAACCTGCCCAACGAGAAGGTGCT<br>GCCCAAGCACAGCCTGCTGTACGAGTACTTCACCGTGTACAACGAGCTGACCAAGGTGAAGTACGTGACCGAGGGCATGC<br>GGAAGCCCGCCTTCCTGAGCGGCGAGCAGAAGAAGGCCATCGTGGACCTGCTGTTCAAGACCAACCGGAAGGTGACCGTG<br>AAGCAGCTGAAGGAGGACTACTTCAAGAAGATCGAGTGCTTCGACAGCGTGGAGATCAGCGGCGTGGAGGACCGGTTCAA<br>CGCCAGCCTGGGCACCTACCACGACCTGCTGAAGATCATCAAGGACAAGGACTTCCTGGACAACGAGGAGAACGAGGACA<br>TCCTGGAGGACATCGTGCTGACCCTGACCCTGTTCGAGGACCGGGAGATGATCGAGGAGCGGCTGAAGACCTACGCCCAC<br>CTGTTCGACGACAAGGTGATGAAGCAGCTGAAGCGGCGGCGGTACACCGGCTGGGGCCGGCTGAGCCGGAAGCTGATCAA<br>CGGCATCCGGGACAAGCAGAGCGGCAAGACCATCCTGGACTTCCTGAAGAGCGACGGCTTCGCCAACCGGAACTTCATGC<br>AGCTGATCCACGACGACAGCCTGACCTTCAAGGAGGACATCCAGAAGGCCCAGGTGAGCGGCCAGGGCGACAGCCTGCAC<br>GAGCACATCGCCAACCTGGCCGGCAGCCCCGCCATCAAGAAGGGCATCCTGCAGACCGTGAAGGTGGTGGACGAGCTGGT<br>GAAGGTGATGGGCCGGCACAAGCCCGAGAACATCGTGATCGAGATGGCCCGGGAGAACCAGACCACCCAGAAGGGCCAG<br>AAGAACAGCCGGGAGCGGATGAAGCGGATCGAGGAGGGCATCAAGGAGCTGGGCAGCCAGATCCTGAAGGAGCACCCCG<br>TGGAGAACACCCAGCTGCAGAACGAGAAGCTGTACCTGTACTACCTGCAGAACGGCCGGGACATGTACGTGGACCAGGAG<br>CTGGACATCAACCGGCTGAGCGACTACGACGTGGACCACATCGTGCCCCAGAGCTTCCTGAAGGACGACAGCATCGACAA<br>CAAGGTGCTGACCCGGAGCGACAAGAACCGGGGCAAGAGCGACAACGTGCCCAGCGAGGAGGTGGTGAAGAAGATGAAG<br>AACTACTGGCGGCAGCTGCTGAACGCCAAGCTGATCACCCAGCGGAAGTTCGACAACCTGACCAAGGCCGAGCGGGGCGG<br>CCTGAGCGAGCTGGACAAGGCCGGCTTCATCAAGCGGCAGCTGGTGGAGACCCGGCAGATCACCAAGCACGTGGCCCAGA<br>TCCTGGACAGCCGGATGAACACCAAGTACGACGAGAACGACAAGCTGATCCGGGAGGTGAAGGTGATCACCCTGAAGAGC<br>AAGCTGGTGAGCGACTTCCGGAAGGACTTCCAGTTCTACAAGGTGCGGGAGATCAACAACTACCACCACGCCCACGACGC<br>CTACCTGAACGCCGTGGTGGGCACCGCCCTGATCAAGAAGTACCCCAAGCTGGAGAGCGAGTTCGTGTACGGCGACTACA<br>AGGTGTACGACGTGCGGAAGATGATCGCCAAGAGCGAGCAGGAGATCGGCAAGGCCACCGCCAAGTACTTCTTCTACAGC<br>AACATCATGAACTTCTTCAAGACCGAGATCACCCTGGCCAACGGCGAGATCCGGAAGCGGCCCCTGATCGAGACCAACGG<br>CGAGACCGGCGAGATCGTGTGGGACAAGGGCCGGGACTTCGCCACCGTGCGGAAGGTGCTGAGCATGCCCCAGGTGAACA<br>TCGTGAAGAAGACCGAGGTGCAGACCGGCGGCTTCAGCAAGGAGAGCATCCTGCCCAAGCGGAACAGCGACAAGCTGATC<br>GCCCGGAAGAAGGACTGGGACCCCAAGAAGTACGGCGGCTTCGACAGCCCCACCGTGGCCTACAGCGTGCTGGTGGTGGC<br>CAAGGTGGAGAAGGGCAAGAGCAAGAAGCTGAAGAGCGTGAAGGAGCTGCTGGGCATCACCATCATGGAGCGGAGCAGC<br>TTCGAGAAGAACCCCATCGACTTCCTGGAGGCCAAGGGCTACAAGGAGGTGAAGAAGGACCTGATCATCAAGCTGCCCAA<br>GTACAGCCTGTTCGAGCTGGAGAACGGCCGGAAGCGGATGCTGGCCAGCGCCGGCGAGCTGCAGAAGGGCAACGAGCTGG<br>CCCTGCCCAGCAAGTACGTGAACTTCCTGTACCTGGCCAGCCACTACGAGAAGCTGAAGGGCAGCCCCGAGGACAACGAG |

TABLE 5-continued

Exemplary Cas9 mRNA Sequences

| SEQ ID NO | Sequence |
|---|---|
| | CAGAAGCAGCTGTTCGTGGAGCAGCACAAGCACTACCTGGACGAGATCATCGAGCAGATCAGCGAGTTCAGCAAGCGGGT<br>GATCCTGGCCGACGCCAACCTGGACAAGGTGCTGAGCGCCTACAACAAGCACCGGGACAAGCCCATCCGGGAGCAGGCCG<br>AGAACATCATCCACCTGTTCACCCTGACCAACCTGGGCGCCCCCGCCGCCTTCAAGTACTTCGACACCACCATCGACCGGA<br>AGCGGTACACCAGCACCAAGGAGGTGCTGGACGCCACCCTGATCCACCAGAGCATCACCGGCCTGTACGAGACCCGGATC<br>GACCTGAGCCAGCTGGGCGGCGACGGCAGCGGCAGCCCCAAGAAGAAGCGGAAGGTGGACGGCAGCCCCAAGAAGAAGC<br>GGAAGGTGGACAGCGGCTGA |
| 515 | ATGGACAAGAAGTACAGCATCGGCCTGGACATCGGCACCAACAGCGTGGGCTGGGCCGTGATCACCGACGAGTACAAGGT<br>GCCCAGCAAGAAGTTCAAGGTGCTGGGCAACACCGACCGGCACAGCATCAAGAAGAACCTGATCGGCGCCCTGCTGTTCG<br>ACAGCGGCGAGACCGCCGAGGCCACCCGGCTGAAGCGGACCGCCCGGCGGCGGTACACCCGGCGGAAGAACCGGATCTG<br>CTACCTGCAGGAGATCTTCAGCAACGAGATGGCCAAGGTGGACGACAGCTTCTTCCACCGGCTGGAGGAGAGCTTCCTGGT<br>GGAGGAGGACAAGAAGCACGAGCGGCACCCCATCTTCGGCAACATCGTGGACGAGGTGGCCTACCACGAGAAGTACCCCA<br>CCATCTACCACCTGCGGAAGAAGCTGGTGGACAGCACCGACAAGGCCGACCTGCGGCTGATCTACCTGGCCCTGGCCCAC<br>ATGATCAAGTTCCGGGGCCACTTCCTGATCGAGGGCGACCTGAACCCCGACAACAGCGACGTGGACAAGCTGTTCATCCAG<br>CTGGTGCAGACCTACAACCAGCTGTTCGAGGAGAACCCCATCAACGCCAGCGGCGTGGACGCCAAGGCCATCCTGAGCGC<br>CCGGCTGAGCAAGAGCCGGCGGCTGGAGAACCTGATCGCCCAGCTGCCCGGCGAGAAGAAGAACGGCCTGTTCGGCAACC<br>TGATCGCCCTGAGCCTGGGCCTGACCCCCAACTTCAAGAGCAACTTCGACCTGGCCGAGGACGCCAAGCTGCAGCTGAGCA<br>AGGACACCTACGACGACGACCTGGACAACCTGCTGGCCCAGATCGGCGACCAGTACGCCGACCTGTTCCTGGCCGCCAAG<br>AACCTGAGCGACGCCATCCTGCTGAGCGACATCCTGCGGGTGAACACCGAGATCACCAAGGCCCCCCTGAGCGCCAGCAT<br>GATCAAGCGGTACGACGAGCACCACCAGGACCTGACCCTGCTGAAGGCCCTGGTGCGGCAGCAGCTGCCCGAGAAGTACA<br>AGGAGATCTTCTTCGACCAGAGCAAGAACGGCTACGCCGGCTACATCGACGGCGGCGCCAGCCAGGAGGAGTTCTACAAG<br>TTCATCAAGCCCATCCTGGAGAAGATGGACGGCACCGAGGAGCTGCTGGTGAAGCTGAACCGGGAGGACCTGCTGCGGAA<br>GCAGCGGACCTTCGACAACGGCAGCATCCCCCACCAGATCCACCTGGGCGAGCTGCACGCCATCCTGCGGCGGCAGGAGG<br>ACTTCTACCCCTTCCTGAAGGACAACCGGGAGAAGATCGAGAAGATCCTGACCTTCCGGATCCCCTACTACGTGGGCCCCC<br>TGGCCCGGGGCAACAGCCGGTTCGCCTGGATGACCCGGAAGAGCGAGGAGACCATCACCCCCTGGAACTTCGAGGAGGTG<br>GTGGACAAGGGCGCCAGCGCCCAGAGCTTCATCGAGCGGATGACCAACTTCGACAAGAACCTGCCCAACGAGAAGGTGCT<br>GCCCAAGCACAGCCTGCTGTACGAGTACTTCACCGTGTACAACGAGCTGACCAAGGTGAAGTACGTGACCGAGGGCATGC<br>GGAAGCCCGCCTTCCTGAGCGGCGAGCAGAAGAAGGCCATCGTGGACCTGCTGTTCAAGACCAACCGGAAGGTGACCGTG<br>AAGCAGCTGAAGGAGGACTACTTCAAGAAGATCGAGTGCTTCGACAGCGTGGAGATCAGCGGCGTGGAGGACCGGTTCAA<br>CGCCAGCCTGGGCACCTACCACGACCTGCTGAAGATCATCAAGGACAAGGACTTCCTGGACAACGAGGAGAACGAGGACA<br>TCCTGGAGGACATCGTGCTGACCCTGACCCTGTTCGAGGACCGGGAGATGATCGAGGAGCGGCTGAAGACCTACGCCCAC<br>CTGTTCGACGACAAGGTGATGAAGCAGCTGAAGCGGCGGCGGTACACCGGCTGGGGCCGGCTGAGCCGGAAGCTGATCAA<br>CGGCATCCGGGACAAGCAGAGCGGCAAGACCATCCTGGACTTCCTGAAGAGCGACGGCTTCGCCAACCGGAACTTCATGC<br>AGCTGATCCACGACGACAGCCTGACCTTCAAGGAGGACATCCAGAAGGCCCAGGTGAGCGGCCAGGGCGACAGCCTGCAC<br>GAGCACATCGCCAACCTGGCCGGCAGCCCCGCCATCAAGAAGGGCATCCTGCAGACCGTGAAGGTGGTGGACGAGCTGGT<br>GAAGGTGATGGGCCGGCACAAGCCCGAGAACATCGTGATCGAGATGGCCCGGGAGAACCAGACCACCCAGAAGGGCCAG<br>AAGAACAGCCGGGAGCGGATGAAGCGGATCGAGGAGGGCATCAAGGAGCTGGGCAGCCAGATCCTGAAGGAGCACCCCG<br>TGGAGAACACCCAGCTGCAGAACGAGAAGCTGTACCTGTACTACCTGCAGAACGGCCGGGACATGTACGTGGACCAGGAG<br>CTGGACATCAACCGGCTGAGCGACTACGACGTGGACCACATCGTGCCCCAGAGCTTCCTGAAGGACGACAGCATCGACAA<br>CAAGGTGCTGACCCGGAGCGACAAGAACCGGGGCAAGAGCGACAACGTGCCCAGCGAGGAGGTGGTGAAGAAGATGAAG<br>AACTACTGGCGGCAGCTGCTGAACGCCAAGCTGATCACCCAGCGGAAGTTCGACAACCTGACCAAGGCCGAGCGGGGCGG<br>CCTGAGCGAGCTGGACAAGGCCGGCTTCATCAAGCGGCAGCTGGTGGAGACCCGGCAGATCACCAAGCACGTGGCCCAGA<br>TCCTGGACAGCCGGATGAACACCAAGTACGACGAGAACGACAAGCTGATCCGGGAGGTGAAGGTGATCACCCTGAAGAGC<br>AAGCTGGTGAGCGACTTCCGGAAGGACTTCCAGTTCTACAAGGTGCGGGAGATCAACAACTACCACCACGCCCACGACGC<br>CTACCTGAACGCCGTGGTGGGCACCGCCCTGATCAAGAAGTACCCCAAGCTGGAGAGCGAGTTCGTGTACGGCGACTACA<br>AGGTGTACGACGTGCGGAAGATGATCGCCAAGAGCGAGCAGGAGATCGGCAAGGCCACCGCCAAGTACTTCTTCTACAGC<br>AACATCATGAACTTCTTCAAGACCGAGATCACCCTGGCCAACGGCGAGATCCGGAAGCGGCCCCTGATCGAGACCAACGG<br>CGAGACCGGCGAGATCGTGTGGGACAAGGGCCGGGACTTCGCCACCGTGCGGAAGGTGCTGAGCATGCCCCAGGTGAACA<br>TCGTGAAGAAGACCGAGGTGCAGACCGGCGGCTTCAGCAAGGAGAGCATCCTGCCCAAGCGGAACAGCGACAAGCTGATC<br>GCCCGGAAGAAGGACTGGGACCCCAAGAAGTACGGCGGCTTCGACAGCCCCACCGTGGCCTACAGCGTGCTGGTGGTGGC<br>CAAGGTGGAGAAGGGCAAGAGCAAGAAGCTGAAGAGCGTGAAGGAGCTGCTGGGCATCACCATCATGGAGCGGAGCAGC<br>TTCGAGAAGAACCCCATCGACTTCCTGGAGGCCAAGGGCTACAAGGAGGTGAAGAAGGACCTGATCATCAAGCTGCCCAA<br>GTACAGCCTGTTCGAGCTGGAGAACGGCCGGAAGCGGATGCTGGCCAGCGCCGGCGAGCTGCAGAAGGGCAACGAGCTGG<br>CCCTGCCCAGCAAGTACGTGAACTTCCTGTACCTGGCCAGCCACTACGAGAAGCTGAAGGGCAGCCCCGAGGACAACGAG<br>CAGAAGCAGCTGTTCGTGGAGCAGCACAAGCACTACCTGGACGAGATCATCGAGCAGATCAGCGAGTTCAGCAAGCGGGT<br>GATCCTGGCCGACGCCAACCTGGACAAGGTGCTGAGCGCCTACAACAAGCACCGGGACAAGCCCATCCGGGAGCAGGCCG<br>AGAACATCATCCACCTGTTCACCCTGACCAACCTGGGCGCCCCCGCCGCCTTCAAGTACTTCGACACCACCATCGACCGGA<br>AGCGGTACACCAGCACCAAGGAGGTGCTGGACGCCACCCTGATCCACCAGAGCATCACCGGCCTGTACGAGACCCGGATC<br>GACCTGAGCCAGCTGGGCGGCGACTGA |
| 516 | GGGAAGCUCAGAAUAAACGCUCAACUUUGGCCGGAUCUGCCACCAUGGACAAGAAGUACUCCAUCGGCCUGGACAUCG<br>GCACCAACUCCGUGGGCUGGGCCGUGAUCACCGACGAGUACAAGGUGCCCUCCAAGAAGUUCAAGGUGCUGGGCAACA<br>CCGACCGGCACUCCAUCAAGAAGAACCUGAUCGGCGCCCUGCUGUUCGACUCCGGCGAGACCGCCGAGGCCACCCGGCU<br>GAAGCGGACCGCCCGGCGGCGGUACACCCGGCGGAAGAACCGGAUCUGCUACCUGCAGGAGAUCUUCUCCAACGAGAU<br>GGCCAAGGUGGACGACUCCUUCUUCCACCGGCUGGAGGAGUCCUUCCUGGUGGAGGAGGACAAGAAGCACGAGCGGCA<br>CCCCAUCUUCGGCAACAUCGUGGACGAGGUGGCCUACCACGAGAAGUACCCCACCAUCUACCACCUGCGGAAGAAGCUG<br>GUGGACUCCACCGACAAGGCCGACCUGCGGCUGAUCUACCUGGCCCUGGCCCACAUGAUCAAGUUCCGGGGCCACUUCC<br>UGAUCGAGGGCGACCUGAACCCCGACAACUCCGACGUGGACAAGCUGUUCAUCCAGCUGGUGCAGACCUACAACCAGC<br>UGUUCGAGGAGAACCCCAUCAACGCCUCCGGCGUGGACGCCAAGGCCAUCCUGUCCGCCCGGCUGUCCAAGUCCCGGCG<br>GCUGGAGAACCUGAUCGCCCAGCUGCCCGGCGAGAAGAAGAACGGCCUGUUCGGCAACCUGAUCGCCCUGUCCCUGGGC<br>CUGACCCCCAACUUCAAGUCCAACUUCGACCUGGCCGAGGACGCCAAGCUGCAGCUGUCCAAGGACACCUACGACGACG<br>ACCUGGACAACCUGCUGGCCCAGAUCGGCGACCAGUACGCCGACCUGUUCCUGGCCGCCAAGAACCUGUCCGACGCCAU<br>CCUGCUGUCCGACAUCCUGCGGGUGAACACCGAGAUCACCAAGGCCCCCCUGUCCGCCUCCAUGAUCAAGCGGUACGAC<br>GAGCACCACCAGGACCUGACCCUGCUGAAGGCCCUGGUGCGGCAGCAGCUGCCCGAGAAGUACAAGGAGAUCUUCUUC<br>GACCAGUCCAAGAACGGCUACGCCGGCUACAUCGACGGCGGCGCCUCCCAGGAGGAGUUCUACAAGUUCAUCAAGCCCA |

TABLE 5-continued

Exemplary Cas9 mRNA Sequences

| SEQ ID NO | Sequence |
|---|---|
| | UCCUGGAGAAGAUGGACGGCACCGAGGAGCUGCUGGUGAAGCUGAACCGGGAGGACCUGCUGCGGAAGCAGCGGACCU |
| | UCGACAACGGCUCCAUCCCCCACCAGAUCCACCUGGGCGAGCUGCACGCCAUCCUGCGGCGGCAGGAGGACUUCUACCC |
| | CUUCCUGAAGGACAACCGGGAGAAGAUCGAGAAGAUCCUGACCUUCCGGAUCCCCUACUACGUGGGCCCCCUGGCCCGG |
| | GGCAACUCCCGGUUCGCCUGGAUGACCCGGAAGUCCGAGGAGACCAUCACCCCCUGGAACUUCGAGGAGGUGGUGGAC |
| | AAGGGCGCCUCCGCCCAGUCCUUCAUCGAGCGGAUGACCAACUUCGACAAGAACCUGCCCAACGAGAAGGUGCUGCCCA |
| | AGCACUCCCUGCUGUACGAGUACUUCACCGUGUACAACGAGCUGACCAAGGUGAAGUACGUGACCGAGGGCAUGCGGA |
| | AGCCCGCCUUCCUGUCCGGCGAGCAGAAGAAGGCCAUCGUGGACCUGCUGUUCAAGACCAACCGGAAGGUGACCGUGA |
| | AGCAGCUGAAGGAGGACUACUUCAAGAAGAUCGAGUGCUUCGACUCCGUGGAGAUCUCCGGCGUGGAGGACCGGUUCA |
| | ACGCCUCCCUGGGCACCUACCACGACCUGCUGAAGAUCAUCAAGGACAAGGACUUCCUGGACAACGAGGAGAACGAGG |
| | ACAUCCUGGAGGACAUCGUGCUGACCCUGACCCUGUUCGAGGACCGGGAGAUGAUCGAGGAGCGGCUGAAGACCUACG |
| | CCCACCUGUUCGACGACAAGGUGAUGAAGCAGCUGAAGCGGCGGCGGUACACCGGCUGGGGCCGGCUGUCCCGGAAGC |
| | UGAUCAACGGCAUCCGGGACAAGCAGUCCGGCAAGACCAUCCUGGACUUCCUGAAGUCCGACGGCUUCGCCAACCGGA |
| | ACUUCAUGCAGCUGAUCCACGACGACUCCCUGACCUUCAAGGAGGACAUCCAGAAGGCCCAGGUGUCCGGCCAGGGCG |
| | ACUCCCUGCACGAGCACAUCGCCAACCUGGCCGGCUCCCCCGCCAUCAAGAAGGGCAUCCUGCAGACCGUGAAGGUGGU |
| | GGACGAGCUGGUGAAGGUGAUGGGCCGGCACAAGCCCGAGAACAUCGUGAUCGAGAUGGCCCGGGAGAACCAGACCAC |
| | CCAGAAGGGCCAGAAGAACUCCCGGGAGCGGAUGAAGCGGAUCGAGGAGGGCAUCAAGGAGCUGGGCUCCCAGAUCCU |
| | GAAGGAGCACCCCGUGGAGAACACCCAGCUGCAGAACGAGAAGCUGUACCUGUACUACCUGCAGAACGGCCGGGACAU |
| | GUACGUGGACCAGGAGCUGGACAUCAACCGGCUGUCCGACUACGACGUGGACCACAUCGUGCCCCAGUCCUUCCUGAA |
| | GGACGACUCCAUCGACAACAAGGUGCUGACCCGGUCCGACAAGAACCGGGGCAAGUCCGACAACGUGCCCUCCGAGGA |
| | GGUGGUGAAGAAGAUGAAGAACUACUGGCGGCAGCUGCUGAACGCCAAGCUGAUCACCCAGCGGAAGUUCGACAACCU |
| | GACCAAGGCCGAGCGGGGCGGCCUGUCCGAGCUGGACAAGGCCGGCUUCAUCAAGCGGCAGCUGGUGGAGACCCGGCA |
| | GAUCACCAAGCACGUGGCCCAGAUCCUGGACUCCCGGAUGAACACCAAGUACGACGAGAACGACAAGCUGAUCCGGGA |
| | GGUGAAGGUGAUCACCCUGAAGUCCAAGCUGGUGUCCGACUUCCGGAAGGACUUCCAGUUCUACAAGGUGCGGGAGAU |
| | CAACAACUACCACCACGCCCACGACGCCUACCUGAACGCCGUGGUGGGCACCGCCCUGAUCAAGAAGUACCCCAAGCUG |
| | GAGUCCGAGUUCGUGUACGGCGACUACAAGGUGUACGACGUGCGGAAGAUGAUCGCCAAGUCCGAGCAGGAGAUCGGC |
| | AAGGCCACCGCCAAGUACUUCUUCUACUCCAACAUCAUGAACUUCUUCAAGACCGAGAUCACCCUGGCCAACGGCGAGA |
| | UCCGGAAGCGGCCCCUGAUCGAGACCAACGGCGAGACCGGCGAGAUCGUGUGGGACAAGGGCCGGGACUUCGCCACCG |
| | UGCGGAAGGUGCUGUCCAUGCCCCAGGUGAACAUCGUGAAGAAGACCGAGGUGCAGACCGGCGGCUUCUCCAAGGAGU |
| | CCAUCCUGCCCAAGCGGAACUCCGACAAGCUGAUCGCCCGGAAGAAGGACUGGGACCCCAAGAAGUACGGCGGCUUCG |
| | ACUCCCCCACCGUGGCCUACUCCGUGCUGGUGGUGGCCAAGGUGGAGAAGGGCAAGUCCAAGAAGCUGAAGUCCGUGA |
| | AGGAGCUGCUGGGCAUCACCAUCAUGGAGCGGUCCUCCUUCGAGAAGAACCCCAUCGACUUCCUGGAGGCCAAGGGCU |
| | ACAAGGAGGUGAAGAAGGACCUGAUCAUCAAGCUGCCCAAGUACUCCCUGUUCGAGCUGGAGAACGGCCGGAAGCGGA |
| | UGCUGGCCUCCGCCGGCGAGCUGCAGAAGGGCAACGAGCUGGCCCUGCCCUCCAAGUACGUGAACUUCCUGUACCUGGC |
| | CUCCCACUACGAGAAGCUGAAGGGCUCCCCCGAGGACAACGAGCAGAAGCAGCUGUUCGUGGAGCAGCACAAGCACUA |
| | CCUGGACGAGAUCAUCGAGCAGAUCUCCGAGUUCUCCAAGCGGGUGAUCCUGGCCGACGCCAACCUGGACAAGGUGCU |
| | GUCCGCCUACAACAAGCACCGGGACAAGCCCAUCCGGGAGCAGGCCGAGAACAUCAUCCACCUGUUCACCCUGACCAAC |
| | CUGGGCGCCCCCGCCGCCUUCAAGUACUUCGACACCACCAUCGACCGGAAGCGGUACACCUCCACCAAGGAGGUGCUGG |
| | ACGCCACCCUGAUCCACCAGUCCAUCACCGGCCUGUACGAGACCCGGAUCGACCUGUCCCAGCUGGGCGGCGACGGCGG |
| | CGGCUCCCCCAAGAAGAAGCGGAAGGUGUGACUAGCACCAGCCUCAAGAACACCCGAAUGGAGUCUCUAAGCUACAUA |
| | AUACCAACUUACACUUUACAAAAUGUUGUCCCCCAAAAUGUAGCCAUUCGUAUCUGCUCCUAAUAAAAAGAAAGUUUC |
| | UUCACAUUCUCUCGAG |

1.2 Human KLKB1 Guide Design and Human KLKB1 with Cynomolgus Homology Guide Design Guide RNAs were designed toward human KLKB1 (ENSG00000164344) targeting the protein coding regions within Exons 1, 2, 3, 4, 5, 6, 7, 8, 9, 10, 11, 12, 13, 14, and 15. Guide RNAs were also designed toward cynomolgus KLKB1 (ENSMFAT00000002355) targeting the protein coding regions within Exons 1, 2, 3, 4, 5, 6, 7, 8, 9, 10, 11, 12, 13, 14, and 15. Guide RNAs and corresponding target genomic coordinates are provided above (Table 1).

1.2. Cas9 (mRNA/Protein) and Guide RNA Delivery In Vitro 1.2.1. Cell Preparation, Delivery In Vitro Primary human hepatocytes (PHH) (Gibco, Lots Hu8296, Hu8300, and Hu8284, Hu8296, HU8290, and HU8317) and primary cynomolgus hepatocytes (PCH) (Gibco, Lots Cy367, Cy400, and 10281011) were thawed and resuspended in hepatocyte thawing medium with supplements (Gibco, Cat. CM7500) followed by centrifugation. The supernatant was discarded and the pelleted cells resuspended in hepatocyte plating medium (William's E Medium (Invitrogen, Cat. A1217601) with Dexamethosone+cocktail supplement, FBS content, and Plating Supplements (Gibco, Cat. CM3000)). Cells were counted and plated on Bio-coat collagen I coated 96-well plates (ThermoFisher, Cat. 877272) at a density of 30,000-35,000 cells/well for PHH and 40,000-45,000 cells/well for PCH. Plated cells were allowed to settle and adhere for 4-6 hours in a tissue culture incubator at 37° C. and 5% $CO_2$ atmosphere. After incubation cells were checked for monolayer formation and were washed once with hepatocyte maintenance medium (William's E Medium with maintenance supplements (Gibco, Cat. CM4000)) or Cellartis® Power Primary HEP Medium (Takara Bio, Cat. Y20020).

Guide RNAs targeting KLKB1 were delivered to cells using a liposomal system with Cas9 protein, for example, or using an LNP formulation comprising Cas9 mRNA and guide RNA as further described below.

1.2.2. RNP Transfection

RNP transfection was used with a liposomal system (Lipofectamine RNAiMAX® (ThermoFisher, Cat. 13778150) and CRISPR reagents (guide RNA, Cas9 Protein) to shuttle a ribonucleoprotein (RNP) complex across the cell membrane.

For studies utilizing dual guide (dgRNA), individual crRNA and trRNA was pre-annealed by mixing equivalent amounts of reagent and incubating at 95° C. for 2 min and cooling to room temperature. The gRNA consisting of pre-annealed crRNA and trRNA was added to Spy Cas9 protein in the reaction buffer (OptiMem) to form an RNP complex and the formed RNP complex was incubated at room temperature for 10 minutes. The RNP complex was diluted with OptiMem to prepare a 1 μm RNP complex stock solution. A Transfection Mix including Lipofectamine RNAiMAX® and OptiMem was prepared and incubated for at least 5 minutes. The Transfection Mix was added to the RNP complex and incubated at room temperature for 10 minutes, and the Transfection Agent (Transfection Mix and RNP complex) was added to cells. Cells were transfected with the RNP complex containing Spy Cas9 protein (10 nM), individual guide/tracer RNA (10 nM), and Lipofectamine RNAiMAX® (1.0 μL/well) and OptiMem.

1.2.3. RNP Electroporation

RNP Electroporation was used with the cell electroporation system (Lonza 4D Nucleofector™ kit 816B0346) and CRISPR reagents, gRNA and Cas9 protein, to shuttle a ribonucleoprotein (RNP) complex across the cell membrane.

For studies utilizing dgRNA, individual crRNA and trRNA were pre-annealed by mixing equivalent amounts of reagent and incubating at 95° C. for 2 min and cooling to room temperature.

For studies utilizing sgRNA, a 50 μM sgRNA stock solution was prepared by incubating equal amounts of 100 μM sgRNA to water at 95° C. for 2 min followed by cooling on ice for 5 minutes. The sgRNA was added to the Spy Cas9 protein in reaction buffer (20 mM Hepes, 100 mM KCl, 1 mM MgCl2, 10% glycerol, 1 mM DTT pH 7.5) to form an RNP complex and incubated at room temperature for 10 minutes. Cells were electroporated (Amaxa™ 96-well Shuttle™ Cat. AAM-1001S) with the RNP complex containing Spy Cas9 protein (2 μM) and gRNA (4 μM) and Lonza P3 buffer (Catalog #: V4SP-3960). Post electroporation, hepatocyte plating media (William's E Medium, Cat. A12176-01) was added to the cell plate, the media with cells was transferred to collagen-coated plates (Corning 354407). After 4-6 hrs, the media was changed to maintenance media (William's E Medium (Gibco, Cat. A12176-01, Lot 2039733) and maintenance supplement (Gibco, Cat. A12176-01, Lot 2039733) for overnight incubation at 37° C.

1.2.4. Preparation of LNP Formulation Containing sgRNA and Cas9 mRNA

In general, the lipid nanoparticle components were dissolved in 100% ethanol at various molar ratios. The RNA cargos (e.g., Cas9 mRNA and sgRNA) were dissolved in 25 mM citrate, 100 mM NaCl, pH 5.0, resulting in a concentration of RNA cargo of approximately 0.45 mg/mL. The LNPs used in Examples 2-10 contained ionizable lipid ((9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate), cholesterol, DSPC, and PEG2k-DMG in a 50:38:9:3 molar ratio, respectively. The LNPs were formulated with a lipid amine to RNA phosphate (N:P) molar ratio of about 6, and a ratio of gRNA to mRNA of 1:2 by weight. The LNPs used in Examples 2-10 comprise a Cas9 mRNA and an sgRNA.

The LNPs were prepared using a cross-flow technique utilizing impinging jet mixing of the lipid in ethanol with two volumes of RNA solutions and one volume of water. The lipid in ethanol was mixed through a mixing cross with the two volumes of RNA solution. A fourth stream of water was mixed with the outlet stream of the cross through an inline tee (See WO2016010840 FIG. 2.). The LNPs were held for 1 hour at room temperature, and further diluted with water (approximately 1:1 v/v). Diluted LNPs were concentrated using tangential flow filtration on a flat sheet cartridge (Sartorius, 100 kD MWCO) and then buffer exchanged using PD-10 desalting columns (GE) into 50 mM Tris, 45 mM NaCl, 5% (w/v) sucrose, pH 7.5 (TSS). The resulting mixture was then filtered using a 0.2 μm sterile filter. The final LNPs were characterized to determine the encapsulation efficiency, polydispersity index, and average particle size. The final LNP was stored at 4° C. or −80° C. until further use.

1.2.5. sgRNA and Cas9 mRNA Lipofection

Lipofection of Cas9 mRNA and gRNAs used pre-mixed lipid formulations. The lipofection reagent contained ionizable lipid ((9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate), cholesterol, DSPC, and PEG2k-DMG in a 50:38:9:3 molar ratio, respectively. This mixture was reconstituted in 100% ethanol then mixed with RNA cargos (e.g., Cas9 mRNA and gRNA) at a lipid amine to RNA phosphate (N:P) molar ratio of about 6.0. Guide RNA was chemically synthesized by commercial vendors or using standard in vitro synthesis techniques with modified nucleotides. A Cas9 ORF of Table 5 was produced by IVT as described in WO2019/067910, see e.g. paragraph [00354], using a 2-hour IVT reaction time and purifying the mRNA by LiCl precipitation followed by tangential flow filtration. Lipofections were performed with 3% cynomolgus serum and a ratio of gRNA to mRNA of 1:1 by weight.

1.2.6. LNP Transfection

Modified sgRNAs targeting human KLKB1 were formulated in LNPs as described in Example 1. Primary human hepatocytes were plated as described in Example 1. Cells were incubated at 37° C., 5% CO2 for 48 hours prior to treatment with LNPs. LNPs were incubated in media containing 3% fetal bovine serum (FBS) at 37° C. for 10 minutes. Post-incubation, media were aspirated from cells and the mixture of media with 3% FBS and LNP was added to the hepatocytes. At 72 to 96 hours post-transfection, a portion of the cells was collected and processed for NGS sequencing as described in Example 1.

1.3. Genomic DNA Isolation

Transfected PHH and PCH were harvested at 48- or 72-hours post-transfection. The gDNA was extracted from each well of a 96-well plate using 50 μL/well BuccalAmp DNA Extraction solution (Epicentre, Cat. QE09050) or Zymo's Quick RNA/DNA extraction kit (Cat. R2130) according to manufacturer's protocol. All DNA samples were subjected to PCR and subsequent NGS analysis, as described herein.

1.4. Next-Generation Sequencing ("NGS") and Analysis for On-Target Cleavage Efficiency To quantitatively determine the efficiency of editing at the target location in the genome, next generation sequencing was utilized to identify the presence of insertions and deletions introduced by gene editing. PCR primers were designed around the target site within the gene of interest (e.g. KLKB1), and the genomic area of interest was amplified. Primer sequence design was done as is standard in the field.

Additional PCR was performed according to the manufacturer's protocols (Illumina) to add chemistry for sequencing. The amplicons were sequenced on an Illumina MiSeq® instrument. The reads were aligned to the human (e.g., hg38) reference genome after eliminating those having low quality scores. The resulting files containing the reads were mapped to the reference genome (BAM files), where reads that overlapped the target region of interest were selected and the number of wild type reads versus the number of reads which contain an insertion or deletion ("indel") was calculated.

The editing percentage (e.g., the "editing efficiency" or "percent editing") is defined as the total number of sequence reads with insertions or deletions ("indels") over the total number of sequence reads, including wild type.

A biochemical assay (See, e.g., Cameron et al., *Nature Methods.* 6, 600-606; 2017) was used to discover potential off-target genomic sites cleaved by Cas9 targeting KLKB1. Purified genomic DNA (gDNA) from cells was digested with in vitro assembled ribonucleoprotein (RNP) of Cas9 and sgRNA, to induce DNA cleavage at the on-target site and potential off-target sites with homology to the sgRNA spacer sequence. After gDNA digestion, the free gDNA fragment ends were ligated with adapters to facilitate edited fragment enrichment and NGS library construction. The NGS libraries were sequenced and, through bioinformatic analysis, the reads were analyzed to determine the genomic coordinates of the free DNA ends. Locations in the human genome with an accumulation of reads were then annotated as potential off-target sites.

In known off-target detection assays, such as the biochemical assay used above, a large number of potential off-target sites are typically recovered, by design, so as to "cast a wide net" for potential sites that can be validated in other contexts, e.g., in a primary cell of interest. For example, the biochemical assay typically overrepresents the number of potential off-target sites as the assay utilizes purified high molecular weight genomic DNA free of the cell environment and is dependent on the dose of Cas9 RNP used. Accordingly, potential off-target sites identified by these assays were validated using targeted sequencing of the identified potential off-target sites.

In one approach to targeted sequencing, Cas9 and an sgRNA of interest (e.g., an sgRNA having potential off-target sites for evaluation) were introduced to PHH or PCH cells. The cells were then lysed and primers flanking the potential off-target site(s) were used to generate an amplicon for NGS analysis. Identification of indels at a certain level can be used to validate a potential off-target site, whereas the lack of indels found at the potential off-target site can indicate a false positive in the off-target assay that was utilized.

Guides showing on-target indel activity were tested for potential off-target genomic cleavage sites with this assay. Repair structures were manually inspected at loci with statistically relevant indel rates at the off-target cleavage sites to validate the repair structures.

1.5 Transcript Analysis by Quantitative PCR

Quantitative PCR was performed to assess KLKB1 transcript levels. To isolate mRNA, the Qiagen RNeasy® Mini Kit (Qiagen, Cat. 74106) was used. The RNeasy® Mini Kit procedure was completed according to the manufacturer's protocol.

RNA was quantified using a Nanodrop® 8000 (ThermoFisher Scientific, Cat. ND-8000-GL). The RNA quantification procedure was completed according to the manufacturer's protocol. RNA samples were stored at −20° C. prior to use.

The Taqman® RNA-to-Ct 1-Step Kit (ThermoFisher Scientific, Cat. 4392938) was used to create the PCR reactions. The reaction set-up was completed according to the manufacturer's protocol. Alternatively, a Cells-to-CT 1-Step TaqMan® Kit (ThermoFisher Scientific, Cat. A25603) was used to produce samples for qPCR. Quantitative PCR probes targeting human or cynomolgus monkey KLKB1 (ThermoFisher Scientific, Cat. 4351372, transcript UniGene ID Hs01111828_m1; ThermoFisher Scientific, Cat. 4331182, transcript UniGene ID Hs00168478_m1), internal control PPIB (ThermoFisher Scientific, Cat. 4351372, transcript UniGene ID Hs00168719_m1; ThermoFisher Scientific, Cat. 4331182, transcript UniGene ID Mf02802985_m1), internal control GAPDH (ThermoFisher Scientific, Cat. 4351372, transcript UniGene ID Hs02786624_g1), and internal control 18S (ThermoFisher Scientific, Cat. 4319413E) were used in the PCR reactions. The StepOnePlus® Real-Time PCR System (ThermoFisher Scientific, Cat. 4376600) was used to perform the real-time PCR reaction and transcript quantification according to the manufacturer's protocol.

Double delta Ct analysis of KLKB1 mRNA was provided using the Ct values determined from the StepOnePlus® Real-Time PCR System. A double delta Ct value was calculated for the Ct values for internal controls within each sample compared to the values for KLKB1. The expression fold change was determined based on the double delta Ct value for each sequence.

1.6. Protein Analysis of Tissue Culture Media by ELISA

PHH or PCH were transfected as previously described. Starting at three days post-transfection and plating (96-well plate), media were changed on cells every two days. Seven to ten days post-transfection, media were removed from cells and then replaced with 100 μL of William's E culture media or Cellartis® Power Primary HEP Medium (Takara Bio, Cat. Y20020). Twenty-four to forty-eight hours later, media was harvested and stored at −20° C. Total secreted KLKB1 protein levels were determined using a prekallikrein ELISA Kit (Abcam, Cat. ab202405), which detects prekallikrein and kallikrein (also, called total kallikrein). Kit reagents and standards were prepared using the manufacturer's protocols. Prior to running the ELISA, frozen media was thawed at room temperature and centrifuged at 1000 rpm for 1 minute to pellet debris and then placed on ice. For the ELISA, 10 to 40 μL of media was diluted with Sample Diluent NS assay diluent to a total volume of 50 ul. The ELISA procedure was completed according to the manufacturer's protocol. The plate was read on a SpectraMax® M5 plate reader. Total kallikrein levels were calculated by SoftMax® Pro software ver. 6.4.2 using a four-parameter logistic curve fit of the standard curve. Reduction of total secreted pre-kallikrein protein for cells treated with KLKB1 reagents was determined when compared to wells treated with control reagents or untreated samples.

1.6.1 Protein Analysis of Serum by ELISA

Serum pre-kallikrein levels were measured in humanized mice using the following procedure. Six to seven days post-dose, animals were euthanized by exsanguination via cardiac puncture under isoflourane anesthesia. Blood was collected into serum separator tubes, and allowed to clot at room temperature for 2 hours before being spun down at 9000 g for 10 min to separate the serum. Samples were stored at −20° C. until analysis.

Pre-kallikrein protein levels were determined using a human pre-kallikrein ELISA Kit (Abcam, Cat. ab202405), which detects prekallikrein and kallikrein (also, called total kallikrein). Briefly, sera were serial diluted with kit sample diluent to a final dilution of 1:500 or 1:1000 fold before adding to the ELISA plate. The assay was carried out according to the manufacturer's protocol. The plate was read on a Clariostar® plate reader (BMG Labtech). Pre-kallikrein levels were calculated by Mars software using a four-parameter logistic curve fit of the standard curve. Reduction of total secreted pre-kallikrein protein for cells treated with KLKB1 reagents was determined when compared to wells treated with control reagents or untreated samples.

1.6.2. Protein Analysis by Western Blot

PHH were treated with LNP formulated with select guide RNAs from Table 1 as further described below. LNPs were incubated in Cellartis® Power Primary HEP Medium (Takara Bio, Cat. Y20020) containing 3% FBS or cynomolgus serum at 37° C. for 10 minutes. Post-incubation the LNPs were added to the human hepatocytes. Starting at three days post-transfection, the medium was changed on cells every two days. Ten to fourteen days post-transfection, for cells plated in a 96-well plate the medium was removed and the cells were lysed with 50 μL/well RIPA buffer (Boston Bio Products, Cat. BP-115) plus freshly added protease inhibitor mixture consisting of complete protease inhibitor cocktail (Sigma, Cat. 11697498001), 1 mM DTT, and 250 U/ml Benzonase (EMD Millipore, Cat. 71206-3) per 30,000 to 45,000 cells. Cells were kept on ice for 30 minutes at which time NaCl (1 M final concentration) was added. Cell lysates were thoroughly mixed and retained on ice for 30 minutes. The whole cell extracts ("WCE") were transferred to a PCR plate and centrifuged to pellet debris. A Bradford assay (Bio-Rad, Cat. 500-0001) was used to assess protein content of the lysates. The Bradford assay procedure was completed according to the manufacturer's protocol. Extracts were stored at −20° C. prior to use.

Western blots were performed to assess KLKB1 protein levels. Lysates were mixed with Laemmli buffer (Boston BioProducts, Cat. BP-111R) and denatured at 95° C. for 10 minutes. Western blots were run using the NuPage® system on 4-12% Bis-Tris gels (ThermoFisher Scientific, Cat. NP0323BOX) according to the manufacturer's protocol followed by wet transfer onto 0.45 μm nitrocellulose membrane (Bio-Rad, Cat. 1620115). After transfer membranes were rinsed thoroughly with water and stained with Ponceau S solution (Boston Bio Products, Cat. ST-180) to confirm complete and even transfer. Blots were blocked using 5% dry milk in TBS for 30 minutes on a lab rocker at room temperature. Blots were rinsed with TBST and probed with rabbit α-kallikrein monoclonal antibody (Abcam, Cat. ab124938) at 1:1000 in TBST. For blots within vitro cell lysate, GAPDH was used as a loading control (Novus, Cat. NB600502) at 1:2500 in TBST and incubated simultaneously with the KLKB1 primary antibody. After incubation, blots were rinsed 3 times for 5 minutes each in TBST. Blots were visualized and analyzed by densitometry using a Licor Odyssey system.

1.6.3. Electrochemiluminescence-Based Detection of Plasma Kallikrein Levels

Plasma kallikrein levels in samples were measured by an immunoassay using an electrochemiluminescence detection platform by MesoScale Discovery (MSD). A 96-well MSD standard plate (Cat. No: L15XA) was coated with 25 or 40 μL of a mouse monoclonal capture antibody for kallikrein (LS-Bio, LS-C38308) at a concentration of 1 μg/mL in PBS overnight at 4° C. On the following day, the wells were washed and then blocked with 150 μL of 3% Blocker-A (MSD, Cat. No: R93AA) and incubated for 1 hour at room temperature on a shaker set to 700 rpm. After washing, the samples for the determination of kallikrein concentration along with a human kallikrein standard of a known concentration, made in-house, were added to the wells and incubated for 2 hours at room temperature on a shaker set to 700 rpm. Both samples and standards were diluted in 1% Blocker-A, optionally with 0.05% Tween20.

After washing, 25 μL of the detection antibody solution was added (LSBio #C185168 at 1 μg/mL and MSD #R32AG at 500 μg/mL in 1% Blocker-A with 0.05% Tween20) and incubated for 1 hour at room temperature. The plate was washed and 150 μL MSD gold Read Buffer (MesoScale Discovery, Cat. No: R92TG) was added to each well. The plate was read using the QuickPlex® SQ 120 (MesoScale Discovery). The plate was washed 3× with PBS with 0.05% Tween20 between the different steps.

1.7. Fluorometric Analysis of Plasma Kallikrein Activity

Total plasma kallikrein activity levels in samples, such as non-human primate (NHP) samples, were measured using the Fluorometric SensoLyte® Rh110 Plasma Kallikrein Activity Assay Kit (Anaspec Cat No: AS-72255). A chloroform pretreatment was performed to inhibit C1-Inhibtor activity by mixing an equal volume of cold chloroform with K2EDTA NHP plasma in a 96-well plate. The plate was then centrifuged for 5 min at 4° C. at 16,000×g and 10 μL of the treated plasma was carefully collected from the top layer. In a 96-well black microplate, the 10 μL of pretreated plasma was mixed with 30 μL of assay buffer, 10 μL of Plasma Prekallikrein Activator and 50 μL of substrate, all of which are provided in the kit and prepared according to kit protocol. The fluorescence measurements were immediately initiated at Ex/Em=490 nm/520 nm with a reading every 5 minutes for 1 hour on a SpectraMax® M5 plate reader. The slope of the linear portion of the kinetic fluorometric readout for a given post-treatment plasma sample is compared to the slope of the pre-treatment plasma sample from the same animal to calculate % basal.

1.7.1 Electrochemiluminescence-Based Detection of Plasma Kallikrein Levels in Non-Human Primates Plasma kallikrein levels in non-human primates (NHP) were measured by an immunoassay using an electrochemiluminescence detection platform by MesoScale Discovery (MSD). A 96-well MSD standard plate (Cat. No: L15XA) was coated with 40 μL of a mouse monoclonal capture antibody for kallikrein (LS-Bio, LS-C38308) at a concentration of 1 μg/mL in PBS overnight at 4° C. On the following day, the wells were washed and then blocked with 150 μL of 3% Blocker-A (MSD, Cat. No: R93AA) and incubated for 1 hour at room temperature on a shaker set to 700 rpm. After washing, NHP samples for the determination of kallikrein concentration along with a NHP kallikrein standard of a known concentration, made in-house, were added to the wells and incubated for 2 hours at room temperature on a shaker set to 700 rpm. Both samples and standards were diluted in 1% Blocker-A with 0.05% Tween20.

After washing, 25 μL of the detection antibody solution was added and incubated for 1 hour at room temperature. The plate was washed and 150 μL MSD gold Read Buffer (MesoScale Discovery, Cat. No: R92TG) was added to each well. The plate was read using the QuickPlex® SQ 120 (MesoScale Discovery). The plate was washed 3× with PBS with 0.05% Tween 20 between the different steps.

1.8 Vascular Permeability Assay

The Evans Blue vascular permeability assay is an established model of edema and vascular leakage that can be used as a model in the study of HAE (see, e.g., Bhattacharjee et al., 2013). The assay is based on the injection of Evans Blue, an albumin-binding dye, in a test animal, typically a mouse. Under physiologic conditions the endothelium is impermeable to albumin, so the albumin-bound Evans blue remains restricted within blood vessels. In pathologic conditions that promote increased vascular permeability, extravasation of Evans Blue can be readily observed qualitatively e.g., by the presence of blue color in the ears, feet, and nose of mice after intravenous injection, or quantitatively by measurement of dye incorporated into tissue, e.g., intestine.

Using the huKLKB1 mouse, a model for vascular permeability was developed to evaluate the potential of KLKB1 editing to mitigate the effects of excess bradykinin production (Bhattacharjee et al., 2013). A modified KLKB1 targeting sgRNA and the Cas9 mRNA was administered in a dose response at total RNA doses of 0.03 mg/kg, 0.1 mg/kg and 0.3 mg/kg. Additional groups were treated with 0.3 mg/kg of non-targeting-LNP control and TSS vehicle control. Thirteen days post-dose, vascular permeability was induced using a 2.5 mg/kg intraperitoneal injection of the angiotensin converting enzyme (ACE) inhibitor captopril. After 15 minutes, a mixture of Evans Blue Dye (30 mg/kg) and dextran sulfate (0.3 mg/kg) was administered by intravenous tail injection. The animals were euthanized 15 minutes after this injection and evaluated for dye extravasation into the colon by optical density (OD) at the absorbance of 600 nm via the CLARIOstar® plate reader (BMG LabTech). Liver and serum were collected to quantify huKLKB1 gene editing and kallikrein protein, respectively.

Example 2: Screening and In Vitro Guide Characterization

2.1. Screening of Dual Guide RNAs (dgRNAs) that Target Human KLKB1

Guides targeting human KLKB1 were prepared as dual guide RNAs and evaluated by transfection into primary human hepatocytes (PHH) and primary cynomolgus hepatocytes (PCH) as described in Example 1. The cells were lysed 48 hours post treatment for NGS analysis as described in Example 1. The guides shown in Table 6 were tested.

TABLE 6

Dual guides and single guides in human and cynomolgus

| human dgRNA | human guide sequence | SEQ ID NO | human sgRNA | cyno sgRNA |
|---|---|---|---|---|
| CR005916 | ACAGGAAACUGUAGCAAACA | 1 | G012253 | NA |
| CR005917 | AUAGAUAAUUCACUUACCAC | 2 | G012254 | NA |
| CR005918 | UACAUCCCCACCUCUGAAGA | 3 | G012255 | NA |
| CR005919 | AACUGAAUAGCAAACACCUU | 89 | NA | NA |
| CR005920 | ACAAUUACCAAUUUCUGAAA | 90 | NA | NA |
| CR005921 | UACAAUUACCAAUUUCUGAA | 91 | NA | NA |
| CR005922 | UCUUGAGGAGUAGAGGAACU | 4 | G012256 | NA |
| CR005923 | GGUGUUUUCUUGAGGAGUAG | 92 | NA | NA |
| CR005924 | ACCAGGUAAAGUUCUUUUGC | 5 | G012257 | NA |
| CR005925 | GGGUAAAUUUUAGAAUGGCA | 6 | G012258 | NA |
| CR005926 | CGGGUAAAUUUUAGAAUGGC | 93 | NA | G013884 |
| CR005927 | CUCCCGGGUAAAUUUUAGAA | 94 | NA | G013925 |
| CR005928 | AUUUACCCGGGAGUUGACUU | 7 | G012259 | NA |
| CR005929 | UACCCGGGAGUUGACUUUGG | 8 | G012260 | NA |
| CR005930 | UAUGGGACACAAGGGAGCUC | 95 | NA | NA |

TABLE 6-continued

Dual guides and single guides in human and cynomolgus

| human dgRNA | human guide sequence | SEQ ID NO | human sgRNA | cyno sgRNA |
|---|---|---|---|---|
| CR005931 | UCUUUGAGAUUGUGUAACAC | 9 | G012261 | NA |
| CR005932 | CUUUGAGAUUGUGUAACACU | 10 | G012262 | NA |
| CR005933 | UUUGAGAUUGUGUAACACUG | 11 | G012263 | NA |
| CR005934 | UUGGAGGAACAAACUCUUCU | 96 | NA | G013912 |
| CR005935 | UGGAGGAACAAACUCUUCUU | 97 | NA | NA |
| CR005936 | CAAACUCUUCUUGGGGAGAG | 98 | NA | NA |
| CR005937 | CUAUGAGUGACCCUCCACAC | 99 | NA | G013886 |
| CR005938 | CUGUGUGGAGGGUCACUCAU | 100 | NA | G013938 |
| CR005939 | GGUCACUCAUAGGACACCAG | 101 | NA | G013946 |
| CR005940 | GUCACUCAUAGGACACCAGU | 102 | NA | G013896 |
| CR005941 | ACUGCUGCCCACUGCUUUGA | 103 | NA | NA |
| CR005942 | ACACUUACCCAUCAAAGCAG | 104 | NA | G013902 |
| CR005943 | UACAUACCAGUGUAAUUCAA | 12 | G012264 | NA |
| CR005944 | AGGAACACCUACCGCUAUAA | 105 | NA | G013871 |
| CR005945 | CUCCGGGACUGUACUUUAAU | 106 | NA | G013889 |
| CR005946 | GUCCCAUACGCAAUCCUAGU | 107 | NA | G013890 |
| CR005947 | CUCAGCACCUUUAUAGCGGU | 108 | NA | G013892 |
| CR005948 | UAUAGCGGUAGGUGUUCCUC | 109 | NA | G013874 |
| CR005949 | CUCCAACUAGGAUUGCGUAU | 13 | G012265 | G013933 |
| CR005950 | CUAUUAAAGUACAGUCCCGG | 110 | NA | G013875 |
| CR005951 | AGGAUUGCGUAUGGGACACA | 14 | G012266 | G013904 |
| CR005952 | GGAUUGCGUAUGGGACACAA | 15 | G012267 | G013901 |
| CR005953 | GUGCUGAGUAACGUGGAAUC | 111 | NA | G013883 |
| CR005954 | UAUAAAGGUGCUGAGUAACG | 112 | NA | G013878 |
| CR005955 | UCUCCAACUAGGAUUGCGUA | 113 | NA | G013908 |
| CR005956 | GUUACUCAGCACCUUUAUAG | 16 | G012268 | G013945 |
| CR005957 | AUAGCGGUAGGUGUUCCUCC | 114 | NA | G013873 |
| CR005958 | CUGCCAAAAGUACAUCGAAC | 115 | NA | G013877 |
| CR005959 | UGCCUAUUAAAGUACAGUCC | 17 | G012269 | NA |
| CR005960 | CUAUGGAUGGUUCUCCAACU | 18 | G012270 | G013922 |
| CR005961 | ACCAAUUUCUGAAAGGGCAC | 116 | NA | NA |
| CR005962 | GUGUUUCUUAAGAUUAUCUA | 117 | NA | NA |
| CR005963 | GAUGUUUGGCGCAUCUAUAG | 19 | G012271 | G013921 |
| CR005964 | CCAAUUUCUGAAAGGGCACA | 118 | NA | NA |
| CR005965 | UUCUUAAGAUUAUCUAUGGA | 119 | NA | G013940 |
| CR005966 | CUGUUCGAUGUACUUUUGGC | 120 | NA | NA |
| CR005967 | UGUUCGAUGUACUUUUGGCA | 121 | NA | G013880 |

TABLE 6-continued

| Dual guides and single guides in human and cynomolgus | | | | |
|---|---|---|---|---|
| human dgRNA | human guide sequence | SEQ ID NO | human sgRNA | cyno sgRNA |
| CR005968 | GGUGGAAUGUGCACCUCAUC | 122 | NA | G013939 |
| CR005969 | GUCCGACACACAAAAGCAUC | 123 | NA | G013894 |
| CR005970 | AUGCGCCAAACAUCCUGCAG | 20 | G012272 | G013885 |
| CR005971 | AAACUGGCAGCGAAUGUUAC | 124 | NA | G013930 |
| CR005972 | UGCCACGCAAACAUUUCACA | 125 | NA | NA |
| CR005973 | GCACCUGUUCGAUGUACUUU | 126 | NA | G013870 |
| CR005974 | AGAUGCGCCAAACAUCCUGC | 127 | NA | NA |
| CR005975 | GCACCUCAUCUGGCAGUAUU | 128 | NA | NA |
| CR005976 | CAUCUGAGAACGCAAGAUGC | 129 | NA | G013934 |
| CR005977 | AUGCCCAAUACUGCCAGAUG | 130 | NA | NA |
| CR005978 | UGCACCUCAUCUGGCAGUAU | 131 | NA | G013944 |
| CR005979 | CUCCUUUAUAAAUGUCUCGA | 21 | G012273 | G013905 |
| CR005980 | AUGUCAUUGAUUGAACUUGC | 132 | NA | G013936 |
| CR005981 | ACAAGCACACGCAUUGUUGG | 133 | NA | G013893 |
| CR005982 | UGUUACUGGUGCACCUUUUU | 22 | G012274 | NA |
| CR005983 | GAUGCGCCAAACAUCCUGCA | 23 | G012275 | G013876 |
| CR005984 | UAUCGCCUUGAUAAAACUCC | 134 | NA | G013926 |
| CR005985 | CCUCAAGAAAACACCAUAUC | 135 | NA | G013906 |
| CR005986 | AAACGCCUUCUUCAGAGGUG | 136 | NA | NA |
| CR005987 | AAAACAAGCACACGCAUUGU | 137 | NA | G013891 |
| CR005988 | CAUCGAACAGGUGCAGUUUC | 138 | NA | G013879 |
| CR005989 | GGCUUCCCCUGCAGGAUGUU | 139 | NA | G013881 |
| CR005990 | UUGAUGACCACAUUGCUUCA | 140 | NA | G013937 |
| CR005991 | AGGAGCCUGGAGUUUUAUCA | 141 | NA | NA |
| CR005992 | AUCUGGCAGUAUUGGGCAUU | 24 | G012276 | G013915 |
| CR005993 | UGCCAUCGAGACAUUUAUAA | 142 | NA | G013899 |
| CR005994 | GCGUGGCAUAUGAAAAAAAC | 25 | G012277 | NA |
| CR005995 | UAUAAAGGAGUUGAUAUGAG | 26 | G012278 | G013913 |
| CR005996 | AGCAAGUUCAAUCAAUGACA | 143 | NA | G013897 |
| CR005997 | GGACAUUCCUUGAAGCAAUG | 144 | NA | NA |
| CR005998 | ACACCUUGAAUUGUACUCAC | 27 | G012279 | NA |
| CR005999 | GUUGGGGUGAUAGGUGCAGA | 145 | NA | NA |
| CR006000 | GAAAACGCCUUCUUCAGAGG | 146 | NA | NA |
| CR006001 | UAUGAAAACGCCUUCUUCAG | 147 | NA | NA |
| CR006002 | CUCAGAUGUGGAUGUUGCCA | 148 | NA | NA |
| CR006003 | CUCUCCUAGGCUUCCCCUGC | 149 | NA | NA |

Figure 1B:
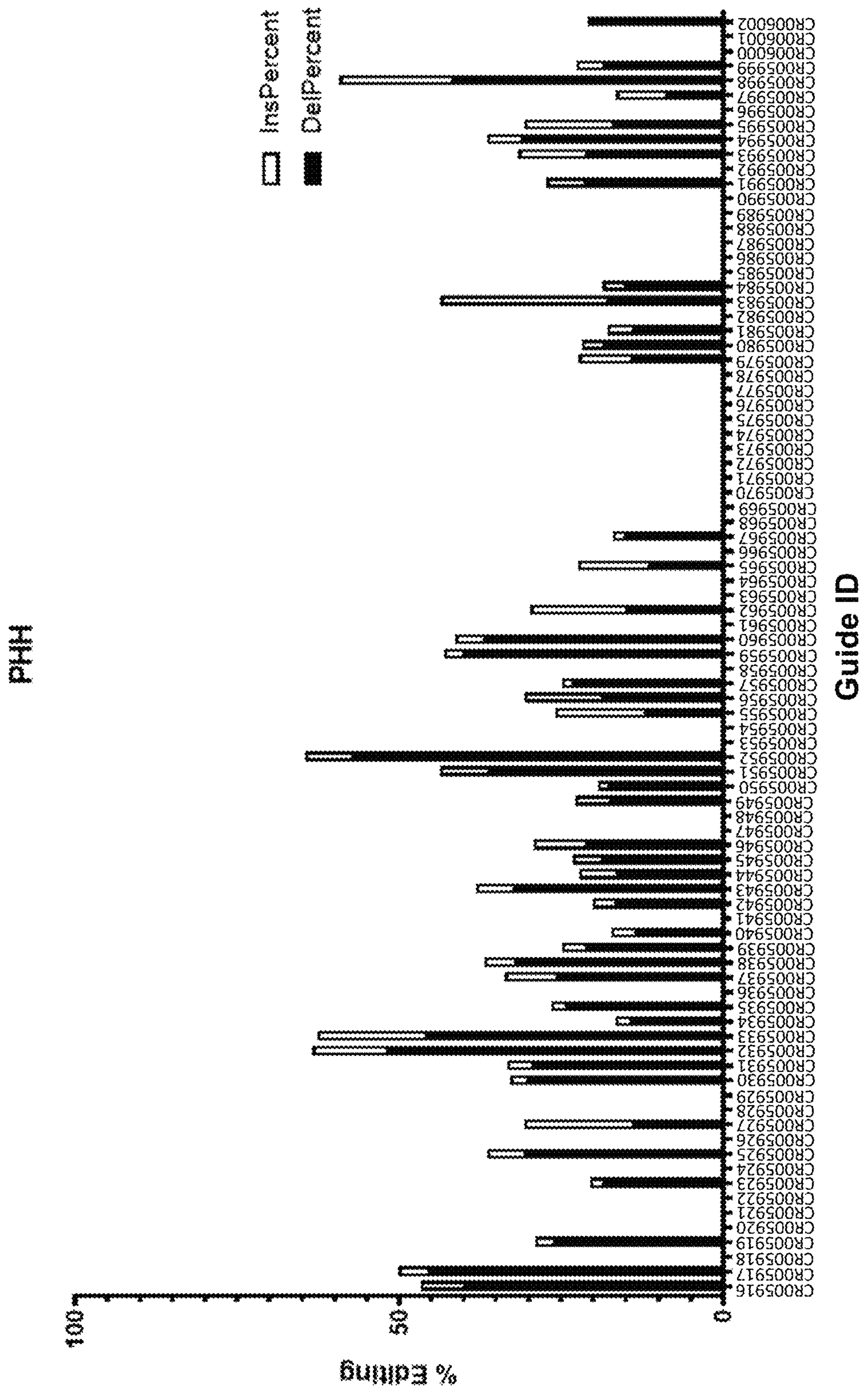
Figure 1C:
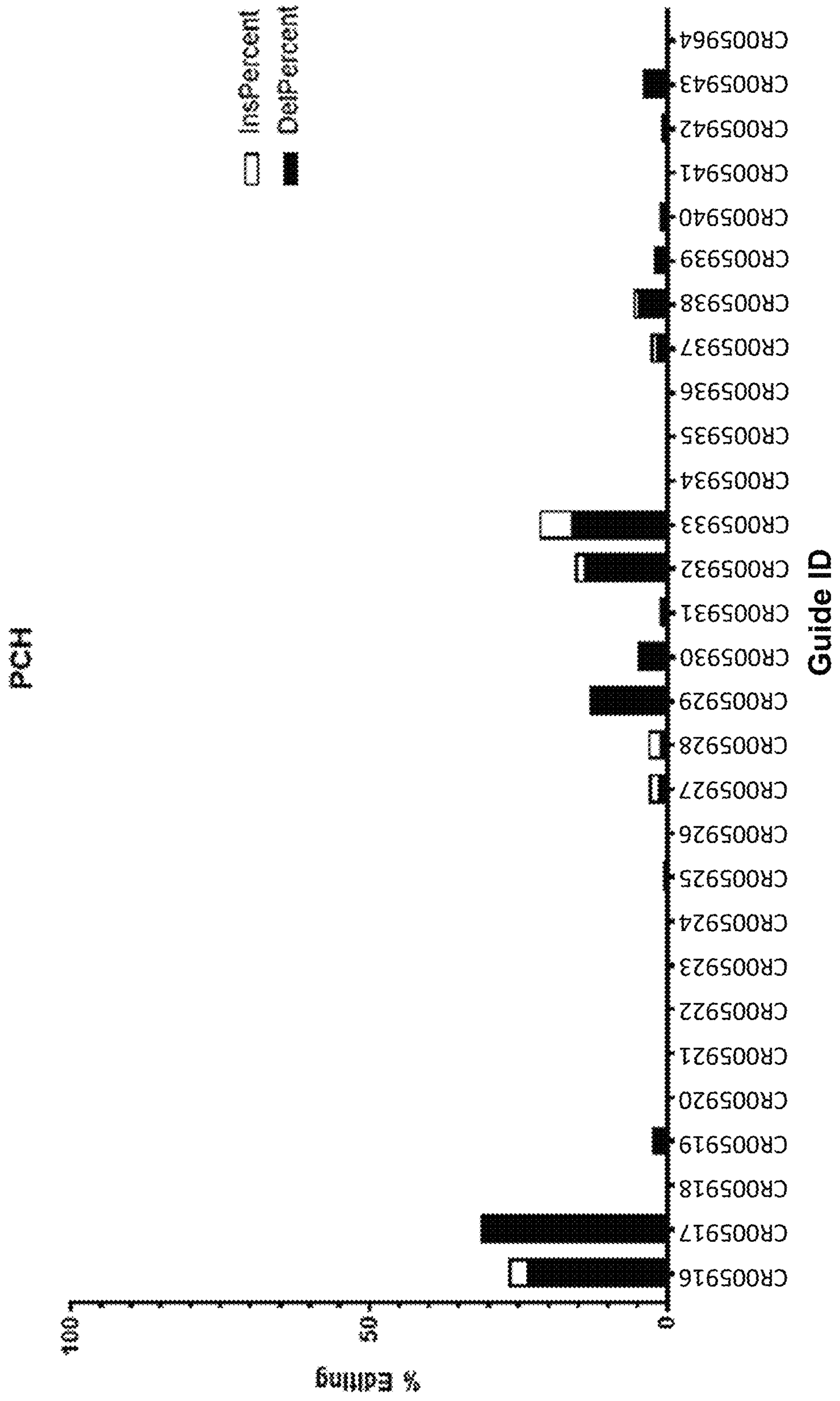
Figure 1D:
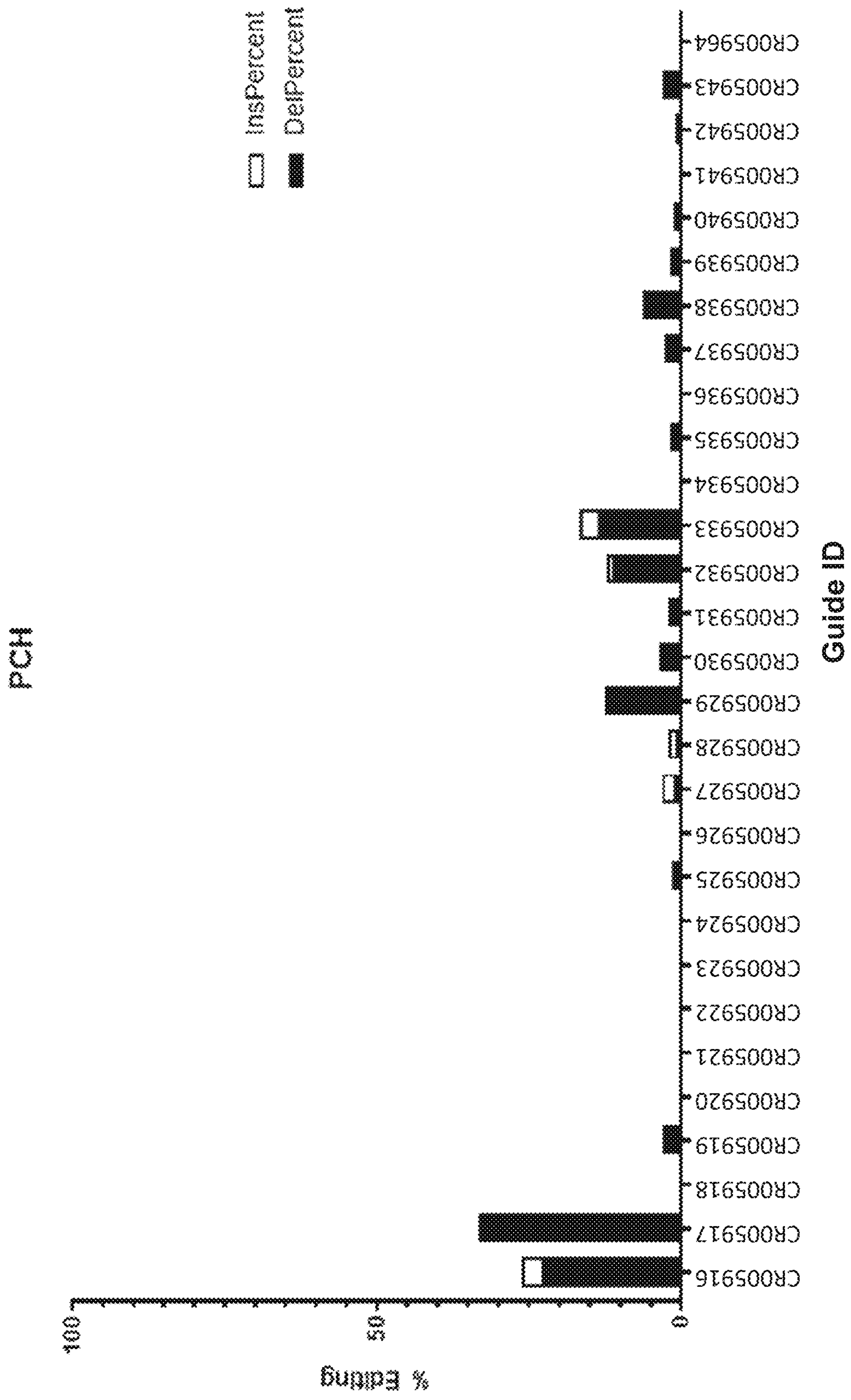

Editing was determined for dgRNAs in two separate sets of PHH and PCH populations. The screening data for the guide sequences are listed in Table 6 above. Table 7A and FIGS. 1A-1B show the percent editing for the KLKB1 targeting guides co-transfected with Spy Cas9 protein in primary human hepatocytes (PHH) (N=2) and Table 7B and FIGS. 1C-1D show those data for primary cynomolgus hepatocytes (PCH) (N=2).

The top performing guide RNAs and corresponding editing data from Set 2 are marked with an asterisk (*) in Tables 7A and 7B. When compared, the sets were determined to be highly correlated (Spearman R=0.985).

TABLE 7A

| KLKB1 editing data for dual guides delivered to primary human hepatocytes: Primer sets 1 & 2 | | | | | |
|---|---|---|---|---|---|
| | SET 1 | | | SET 2 | |
| GUIDE ID | Avg % Edit | Std Dev % Edit | GUIDE ID | Avg % Edit | Std Dev % Edit |
| CR005916* | 44.8 | 4.67 | CR005916* | 46.8 | 1.7 |
| CR005917* | 45.75 | 1.77 | CR005917* | 49.9 | 4.38 |
| CR005918 | ND | ND | CR005918 | ND | ND |
| CR005919 | 24.6 | 0.28 | CR005919 | 28.9 | 4.81 |
| CR005920 | 9.35 | 0.35 | CR005920 | 10.7 | 0.99 |
| CR005921 | 6.15 | 1.06 | CR005921 | 5.55 | 0.64 |
| CR005922 | ND | ND | CR005922 | 19.25 | 1.91 |
| CR005923 | 19.25 | 4.74 | CR005923 | 20.35 | 2.76 |
| CR005924 | 6.1 | 0.71 | CR005924 | 5.55 | 0.78 |
| CR005925* | 35.55 | 1.06 | CR005925* | 36.3 | 1.41 |
| CR005926 | 11.95 | 4.45 | CR005926 | 11.2 | 2.83 |
| CR005927 | 29.2 | 4.24 | CR005927 | 30.4 | 2.97 |
| CR005928 | ND | ND | CR005928 | 33.45 | 4.03 |
| CR005929 | ND | ND | CR005929 | 51.35 | 0.07 |
| CR005930* | 32.45 | 0.21 | CR005930* | 32.6 | 8.06 |
| CR005931* | 37.85 | 5.02 | CR005931* | 33.15 | 1.63 |
| CR005932* | 62.25 | 3.04 | CR005932* | 63.25 | 4.6 |
| CR005933* | 70.05 | 1.91 | CR005933* | 62.45 | 2.47 |
| CR005934 | 17 | 2.12 | CR005934 | 16.5 | 0.71 |
| CR005935 | 26.25 | 0.35 | CR005935 | 26.45 | 3.75 |
| CR005936 | 4.55 | 0.64 | CR005936 | 5 | 0.71 |
| CR005937* | 32.6 | 0.99 | CR005937* | 32.45 | 1.63 |
| CR005938* | 39.25 | 8.7 | CR005938* | 36.85 | 5.87 |
| CR005939 | 27 | 0.57 | CR005939 | 24.85 | 3.46 |
| CR005940 | 16.7 | 2.12 | CR005940 | 17.15 | 1.91 |
| CR005941 | 8.9 | 0.85 | CR005941 | 8.95 | 1.48 |
| CR005942 | 19.8 | 0.71 | CR005942 | 20.05 | 0.49 |
| CR005943* | 38.3 | 6.08 | CR005943* | 38.05 | 3.32 |
| CR005944 | 23.55 | 1.91 | CR005944 | 22.05 | 4.17 |
| CR005945 | 21.95 | 1.63 | CR005945 | 23.05 | 1.63 |
| CR005946 | 29.35 | 2.47 | CR005946 | 27.4 | 2.55 |
| CR005947 | 12.4 | 2.97 | CR005947 | 12.55 | 1.63 |
| CR005948 | 15.2 | 1.56 | CR005948 | 14.5 | 0.85 |
| CR005949 | 19.15 | 2.33 | CR005949 | 19.5 | 0.99 |
| CR005950 | 21.6 | 2.12 | CR005950 | 19.2 | 1.7 |
| CR005951* | 44.9 | 1.41 | CR005951* | 43.45 | 3.75 |
| CR005952* | 63.4 | 3.11 | CR005952* | 64.4 | 2.26 |
| CR005953 | 5.7 | 0 | CR005953 | 6.35 | 1.06 |
| CR005954 | 12.5 | 1.7 | CR005954 | 12.8 | 0.57 |
| CR005955 | 24.65 | 3.04 | CR005955 | 24.95 | 0.64 |
| CR005956* | 31.35 | 0.92 | CR005956* | 30.55 | 4.88 |
| CR005957 | 22.95 | 2.05 | CR005957 | 24.8 | 1.41 |
| CR005958 | 16.45 | 1.2 | CR005958 | 12.05 | 2.33 |
| CR005959* | 42.4 | 3.11 | CR005959* | 42.95 | 4.17 |
| CR005960* | 38.7 | 0.57 | CR005960* | 41.1 | 4.38 |
| CR005961 | 15.2 | 0.71 | CR005961 | 13.8 | 3.25 |
| CR005962* | 31.4 | 0 | CR005962* | 29.65 | 0.92 |
| CR005963 | ND | ND | CR005963 | 45.25 | 9.97 |
| CR005964 | 17.45 | 1.91 | CR005964 | 15.65 | 3.89 |
| CR005965 | 25.25 | 2.33 | CR005965 | 22.25 | 0.21 |
| CR005966 | 8.35 | 2.9 | CR005966 | 6.15 | 0.49 |
| CR005967 | 19.5 | 2.55 | CR005967 | 16.7 | 3.11 |
| CR005968 | 11.55 | 2.33 | CR005968 | 11.65 | 1.91 |
| CR005969 | 13.5 | 2.26 | CR005969 | 12.35 | 3.75 |
| CR005970 | ND | ND | CR005970 | 22.25 | 4.17 |
| CR005971 | 1.1 | 0.42 | CR005971 | 1.15 | 0.64 |

TABLE 7A-continued

KLKB1 editing data for dual guides delivered to primary human hepatocytes: Primer sets 1 & 2

| | SET 1 | | | SET 2 | |
|---|---|---|---|---|---|
| GUIDE ID | Avg % Edit | Std Dev % Edit | GUIDE ID | Avg % Edit | Std Dev % Edit |
| CR005972 | 13.65 | 1.63 | CR005972 | 12.1 | 2.97 |
| CR005973 | 6.45 | 0.21 | CR005973 | 5.25 | 1.06 |
| CR005974 | ND | ND | CR005974 | 16.7 | 1.27 |
| CR005975 | 7.95 | 1.34 | CR005975 | 6.75 | 0.92 |
| CR005976 | ND | ND | CR005976 | 14.6 | 0.99 |
| CR005977 | 12.2 | 2.69 | CR005977 | 13.65 | 3.32 |
| CR005978 | 9.95 | 1.06 | CR005978 | 9.25 | 0.92 |
| CR005979 | 22.35 | 1.63 | CR005979 | 22.15 | 0.21 |
| CR005980 | 18.2 | 2.26 | CR005980 | 21.25 | 0.78 |
| CR005981 | 18.2 | 1.27 | CR005981 | 17.8 | 0.42 |
| CR005982 | 6.25 | 1.77 | CR005982 | 3.95 | 2.76 |
| CR005983* | 53 | NA | CR005983* | 43.3 | 9.9 |
| CR005984 | 17.7 | 7.07 | CR005984 | 18.45 | 5.73 |
| CR005985 | 15.1 | 8.91 | CR005985 | 16.3 | 0.71 |
| CR005986 | ND | ND | CR005986 | ND | ND |
| CR005987 | 10.6 | 2.12 | CR005987 | 9.8 | 0.85 |
| CR005988 | 8.55 | 2.05 | CR005988 | 6.4 | 1.13 |
| CR005989 | ND | ND | CR005989 | 4.9 | 0.42 |
| CR005990 | ND | ND | CR005990 | 20.2 | 6.36 |
| CR005991 | 28.15 | 2.9 | CR005991 | 26.9 | 4.81 |
| CR005992 | 1.65 | 0.21 | CR005992 | 4.85 | 0.92 |
| CR005993* | 38 | 1.27 | CR005993* | 31.35 | 1.2 |
| CR005994* | 33.4 | 1.98 | CR005994* | 36.4 | 1.98 |
| CR005995 | 22.55 | 2.47 | CR005995 | 30.65 | 7.14 |
| CR005996 | 16.55 | 0.64 | CR005996 | 13.75 | 3.46 |
| CR005997 | 22.05 | 1.2 | CR005997 | 16.45 | 3.61 |
| CR005998* | 56.65 | 2.33 | CR005998* | 59.05 | 14.07 |
| CR005999 | 25 | 3.68 | CR005999 | 22.45 | 2.19 |
| CR006000 | ND | ND | CR006000 | ND | ND |
| CR006001 | ND | ND | CR006001 | ND | ND |
| CR006002 | 23.25 | 3.75 | CR006002 | 20.85 | 2.05 |
| CR006003 | ND | ND | CR006003 | 7 | 1.13 |

*"selected dgRNA", a subset of the tested guide RNAs

TABLE 7B

KLKB1 editing data for crRNAs delivered to primary cynomolgus hepatocytes: Sets 1 & 2

| | SET 1 | | | SET 2 | |
|---|---|---|---|---|---|
| GUIDE ID | Avg % Edit | Std Dev % Edit | GUIDE ID | Avg % Edit | Std Dev % Edit |
| CR005916* | 26.6 | 2.4 | CR005916* | 26.1 | 1.8 |
| CR005917* | 31.5 | 3.3 | CR005917* | 33.2 | 2.8 |
| CR005918* | 0.6 | 0.2 | CR005918 | ND | ND |
| CR005919* | 2.5 | ND | CR005919* | 3.2 | 0.3 |
| CR005920* | 0.4 | 0.1 | CR005920 | 0.1 | 0.1 |
| CR005921 | 0.1 | 0.0 | CR005921 | 0.1 | 0.1 |
| CR005010 | 72.8 | 0.2 | CR005010 | 65.7 | 0.9 |
| CR005922* | 0.5 | 0.1 | CR005922* | 0.6 | 0.3 |
| CR005923 | 0.4 | 0.1 | CR005923 | 0.3 | 0.1 |
| CR005924 | 0.2 | 0.0 | CR005924 | 0.2 | 0.2 |
| CR005925* | 0.7 | 0.4 | CR005925* | 1.5 | 0.3 |
| CR005926 | 0.0 | 0.0 | CR005926 | 0.0 | 0.0 |
| CR005927* | 3.1 | 0.8 | CR005927* | 3.2 | 0.2 |
| CR005928* | 3.3 | 1.6 | CR005928* | 2.2 | 0.4 |
| CR005929* | 13.0 | 2.7 | CR005929* | 12.5 | 0.0 |
| CR005930* | 5.0 | 0.9 | CR005930* | 3.6 | 1.3 |
| CR005931* | 1.3 | 0.0 | CR005931* | 2.3 | 0.0 |
| CR005932* | 15.5 | 3.5 | CR005932* | 12.2 | 5.7 |
| CR005933* | 21.5 | 2.6 | CR005933* | 16.6 | ND |
| CR005934 | ND | ND | CR005934 | 0.3 | 0.2 |
| CR005935 | ND | ND | CR005935* | 2.0 | 0.1 |
| CR005936 | 0.1 | 0.0 | CR005936 | ND | ND |
| CR005937* | 2.8 | 0.1 | CR005937* | 2.9 | 0.1 |
| CR005938* | 5.8 | 0.4 | CR005938* | 6.2 | 0.0 |
| CR005939* | 2.3 | 0.1 | CR005939* | 1.9 | 0.4 |

TABLE 7B-continued

KLKB1 editing data for crRNAs delivered to primary cynomolgus hepatocytes: Sets 1 & 2

| | SET 1 | | | SET 2 | |
|---|---|---|---|---|---|
| GUIDE ID | Avg % Edit | Std Dev % Edit | GUIDE ID | Avg % Edit | Std Dev % Edit |
| CR005940* | 1.2 | 0.3 | CR005940* | 1.2 | 0.3 |
| CR005025 | 31.3 | 10.8 | CR005025 | 36.5 | ND |
| CR005941 | 0.4 | 0.1 | CR005941* | 0.3 | 0.0 |
| CR005942* | 1.2 | 0.6 | CR005942* | 1.0 | 0.8 |
| CR005943* | 4.0 | 0.4 | CR005943* | 3.1 | 0.0 |
| CR005020 | 29.5 | 1.5 | CR005020 | 30.7 | 0.6 |
| CR003187 | 14.5 | 0.6 | CR003187 | 15.2 | 2.2 |
| CR005964 | 0.3 | 0.4 | CR005964 | 0.1 | 0.1 |
| CR005032 | 5.3 | 1.6 | CR005032 | 4.5 | 0.9 |

Figure 2A:
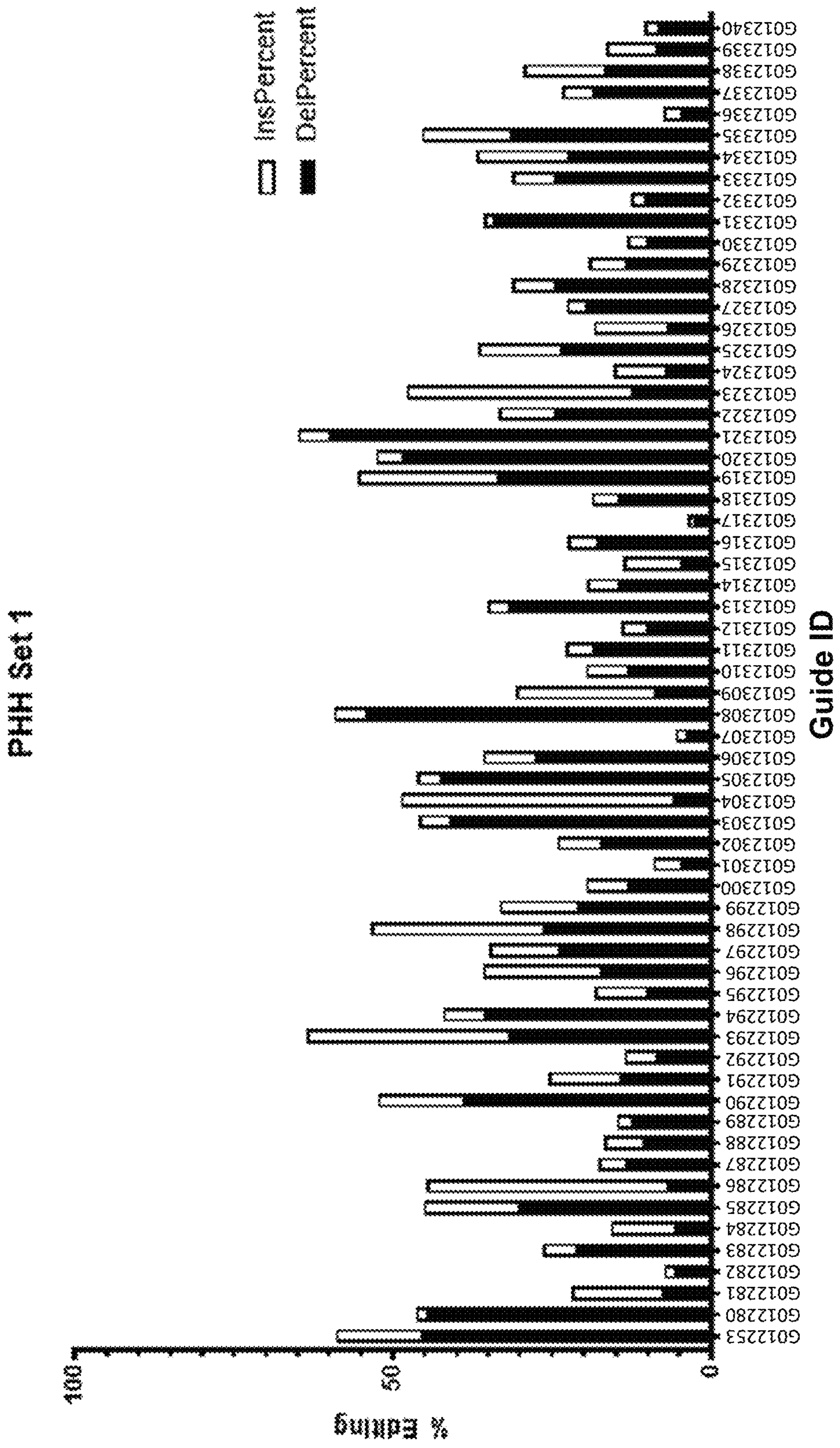
FIGS. 2A-2D show percent editing (indel frequency) of KLKB1 sgRNAs in PHH (FIGS. 2A-2B) and PCH (FIGS. 2C-2D).
Figure 2B:
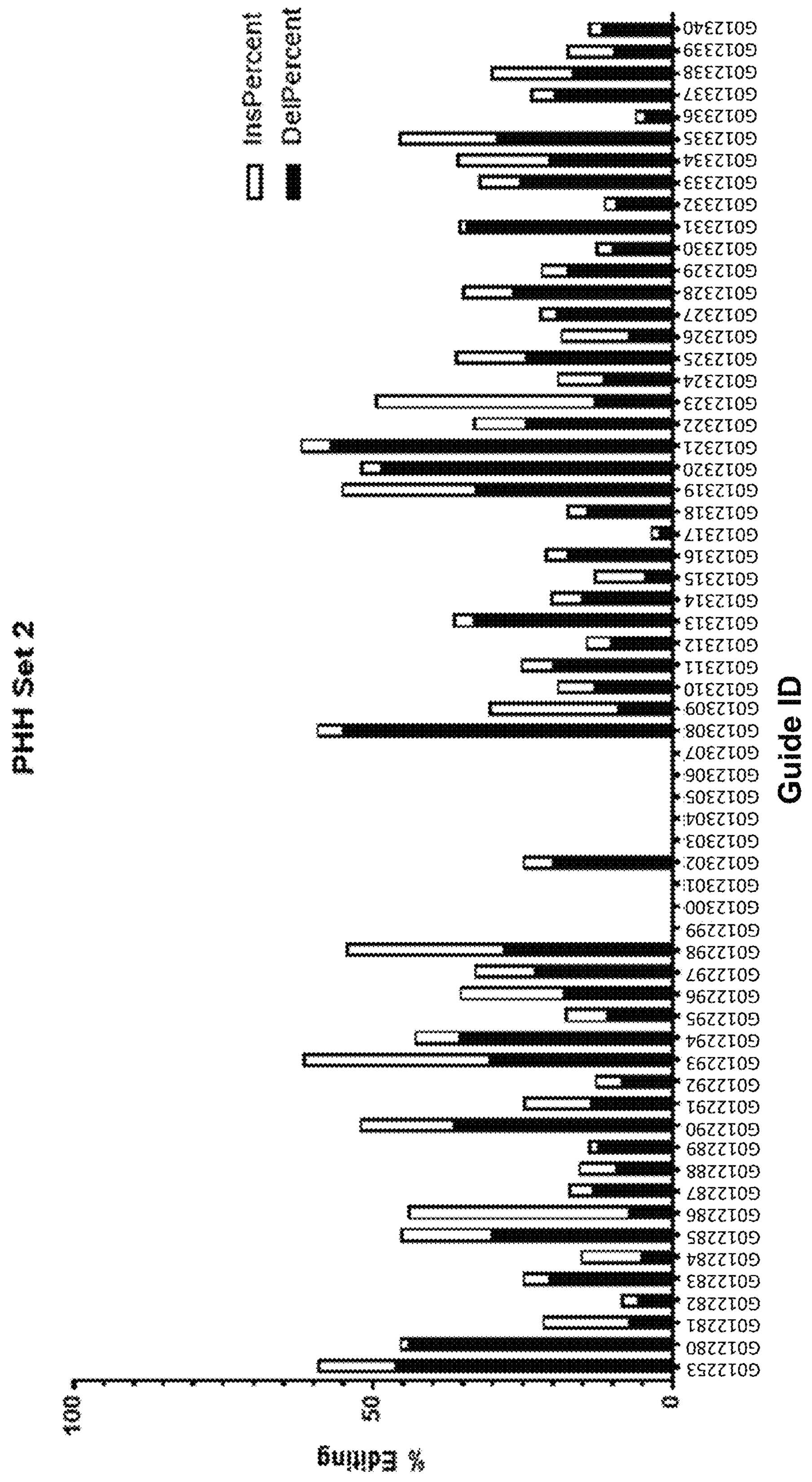
Figure 2C:
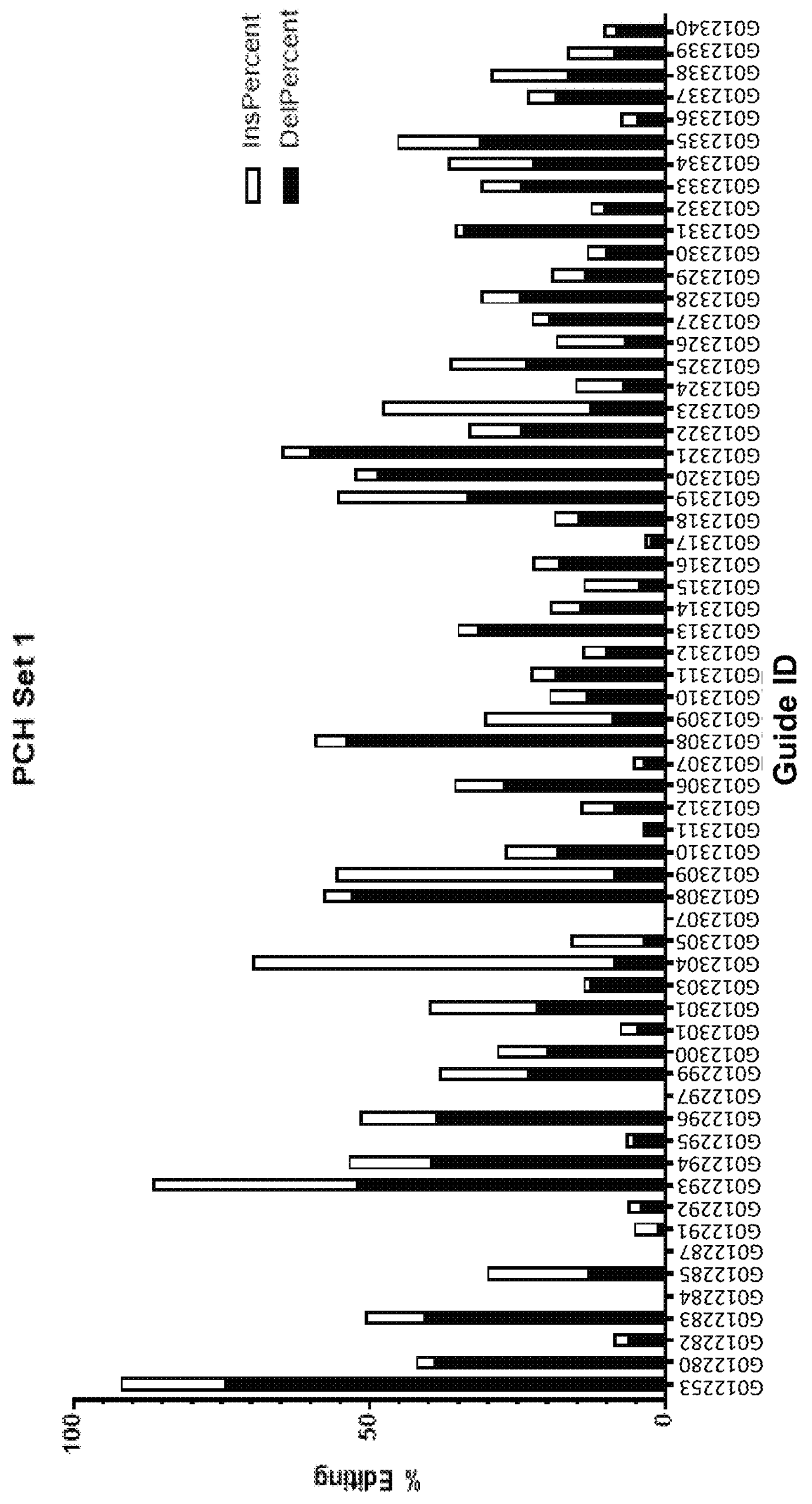
Figure 2D:
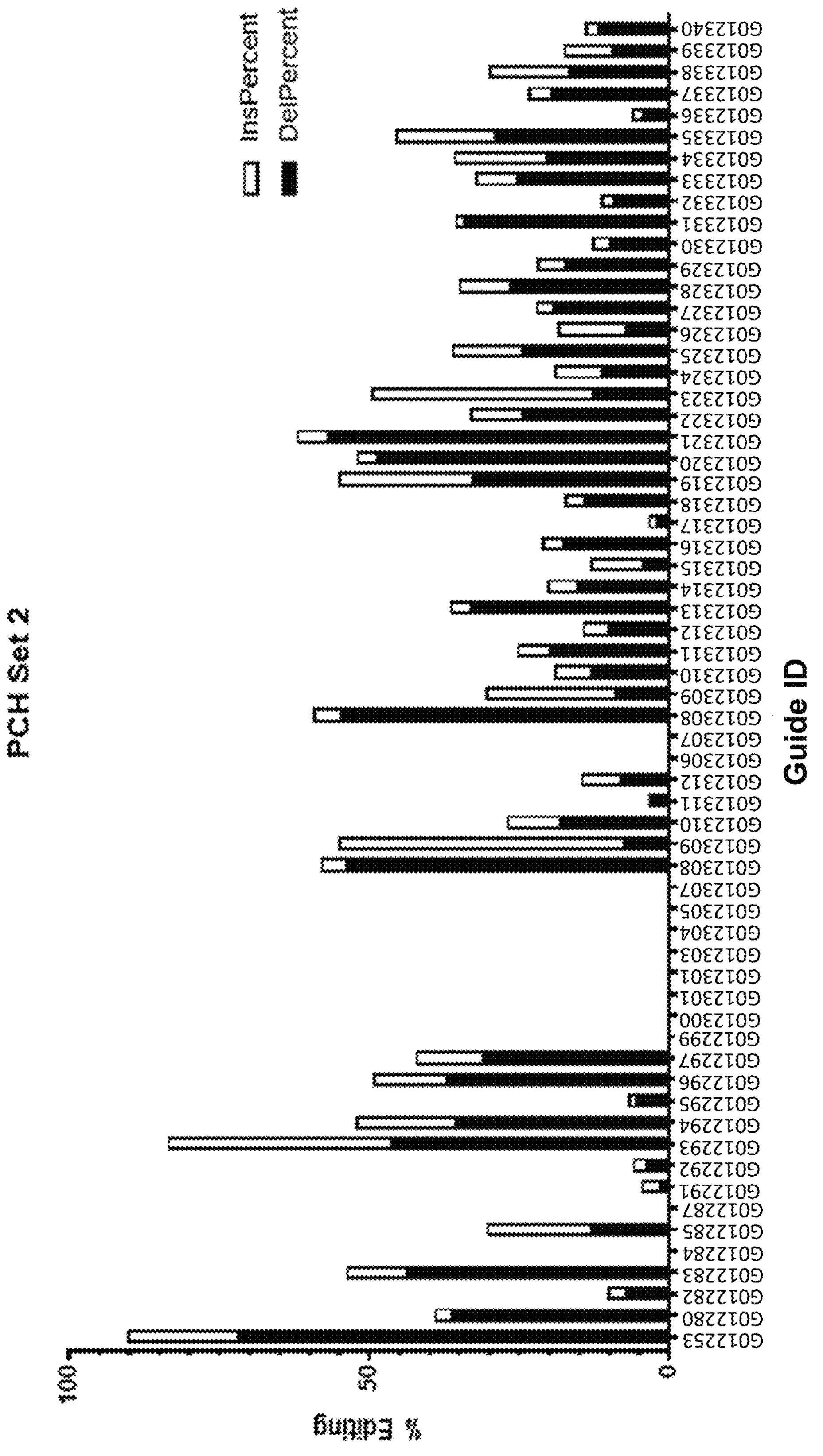

*"selected dgRNA", a subset of the tested guide RNAs 2.1.1 Cross Screening of sgRNAs in PHH and PCH, Editing Selected guide sequences targeting KLKB1 were prepared as sgRNAs and further evaluated in PITH and PCH. PITH and PCH (Gibco, Lot Hu8298) were prepared and transfected with RNP as described in Example 1. The cells were lysed at 48 and 72 hours, respectively, post-treatment for NGS analysis as described in Example 1. Table 8A and FIGS. 2A-2B show percent editing in PITH and Table 8B and FIGS. 2C-2D show percent editing in PCH.

TABLE 8A

KLKB1 editing data for sgRNAs delivered to primary human hepatocytes: Sets 1 & 2

| | SET 1 | | | SET 2 | |
|---|---|---|---|---|---|
| GUIDE ID | Avg % Edit | Std Dev % Edit | GUIDE ID | Avg % Edit | Std Dev % Edit |
| G012321* | 64.7 | 5.8 | G012321* | 62 | 5.5 |
| G012102 | 64 | 5.7 | G012102 | 63.6 | 4.7 |
| G012293* | 63.5 | 4.4 | G012293* | 61.6 | 3.9 |
| G009246 | 63.3 | 3.1 | G009246 | 62.3 | 4.6 |
| G012308* | 59.0 | 1.6 | G012308* | 59 | 1.5 |
| G012253* | 58.6 | 3.5 | G012253* | 59.1 | 1.7 |
| G012319* | 55.3 | 0.9 | G012319* | 55.1 | 3.6 |
| G012298* | 53.1 | 4.2 | G012298* | 54 | 4.9 |
| G012320* | 52.5 | 5.5 | G012320* | 51.9 | 7.7 |
| G012290* | 52.0 | 1.4 | G012290* | 51.7 | 0.9 |
| G012304* | 48.7 | 2.7 | G012304 | NA | NA |
| G012323* | 47.4 | 1.4 | G012323* | 49.1 | 1.1 |
| G012280* | 46.2 | 4.0 | G012280* | 45.4 | 5.4 |
| G012305* | 46.1 | 5.2 | G012305 | NA | NA |
| G012303* | 45.4 | 7.4 | G012303 | NA | NA |
| G012285* | 45.1 | 7.6 | G012285* | 45.2 | 8.6 |
| G012335* | 45.1 | 2.4 | G012335* | 44.7 | 3.2 |
| G012286* | 44.7 | 5.3 | G012286* | 43.9 | 3.5 |
| G000644 | 42.4 | 9.9 | G000644 | 42.7 | 9.5 |
| G012294* | 42.0 | 1.3 | G012294* | 43 | 2.4 |
| G009267 | 41.6 | 0.6 | G009267 | 45.8 | 1.3 |
| G009285 | 37.7 | 1.7 | G009285 | 35.6 | 1.3 |
| G012334* | 36.4 | 2.5 | G012334* | 36 | 5.3 |
| G012325* | 36.2 | 1.8 | G012325* | 36.4 | 3.6 |
| G012296* | 35.9 | 6.2 | G012296* | 35.4 | 7.8 |
| G012331 | 35.5 | 3.0 | G012331* | 35.7 | 1.2 |
| G012306 | 34.9 | 1.8 | G012306 | NA | NA |
| G012313 | 34.9 | 1.3 | G012313* | 36.3 | 3.3 |
| G012297 | 34.4 | 4.7 | G012297 | 32.7 | 4.7 |
| G012322 | 32.9 | 0.4 | G012322 | 33.2 | 0.4 |
| G012299 | 32.4 | 0.7 | G012299 | NA | NA |
| G012333 | 31.3 | 0.4 | G012333 | 32.3 | 3.3 |
| G012328 | 31.2 | 2.3 | G012328* | 34.9 | 0.1 |
| G012309 | 30.4 | 0.1 | G012309 | 29.9 | 2.3 |
| G009321 | 29.9 | 2 | G009321 | 31.8 | 4.5 |
| G012338 | 29.0 | 2.2 | G012338 | 29.7 | 2.3 |
| G012283 | 26.2 | 4.2 | G012283 | 24.9 | 4.1 |
| G012291 | 25.3 | 2.3 | G012291 | 24.7 | 3.7 |

TABLE 8A-continued

KLKB1 editing data for sgRNAs delivered to primary human hepatocytes: Sets 1 & 2

| | SET 1 | | | SET 2 | |
|---|---|---|---|---|---|
| GUIDE ID | Avg % Edit | Std Dev % Edit | GUIDE ID | Avg % Edit | Std Dev % Edit |
| G012302 | 23.2 | NA | G012302 | 24.6 | 3.1 |
| G012337 | 23.0 | 2.3 | G012337 | 23.6 | 0.5 |
| G012311 | 22.8 | 0.8 | G012311 | 23.9 | 0.2 |
| G012144 | 22.6 | 1.5 | G012144 | 22.9 | 0.9 |
| G012327 | 22.4 | 3.5 | G012327 | 21.7 | 3.4 |
| G012316 | 22.3 | 0.1 | G012316 | 21.1 | 0.5 |
| G000645 | 22 | 0.7 | G000645 | 22.5 | 1.6 |
| G012281 | 20.9 | 0.1 | G012281 | 21.5 | 0.1 |
| G012300 | 19.2 | 2.6 | G012300 | NA | NA |
| G012310 | 19.2 | 2.5 | G012310 | 18.2 | 0.1 |
| G012329 | 19.2 | 1.6 | G012329 | 21.7 | 0.8 |
| G012318 | 18.8 | 0.7 | G012318 | 17.5 | 0.6 |
| G012314 | 18.6 | 0.7 | G012314 | 19.6 | 2.7 |
| G012326 | 18.4 | 3.2 | G012326 | 18.5 | 3.2 |
| G012295 | 17.7 | 3.6 | G012295 | 17.6 | 5.7 |
| G012287 | 17.2 | 0.4 | G012287 | 17 | 2.4 |
| G012288 | 16.7 | 0.1 | G012288 | 15.4 | 0.3 |
| G012339 | 16.5 | 2.6 | G012339 | 17.6 | 1.3 |
| G012284 | 15.3 | 0.3 | G012284 | 15.4 | 1.5 |
| G012324 | 15.3 | 2.2 | G012324 | 19.1 | 3.5 |
| G012289 | 14.3 | 1.8 | G012289 | 13.6 | 0.8 |
| G012312 | 14.0 | 0.8 | G012312 | 14.4 | NA |
| G012292 | 13.4 | 3.6 | G012292 | 12.9 | 3 |
| G012330 | 13.3 | 1.9 | G012330 | 12.9 | 0.6 |
| G012315 | 13.0 | 0.1 | G012315 | 12.8 | 1.9 |
| G012332 | 12.6 | 1.0 | G012332 | 11.5 | 0.6 |
| G012340 | 10.5 | 2.3 | G012340 | 13.9 | 1.8 |
| G012301 | 9.2 | 0.1 | G012301 | NA | NA |
| G012336 | 7.5 | 1.6 | G012336 | 6.3 | 1.8 |
| G012282 | 7.3 | 1.2 | G012282 | 8.6 | 2.3 |
| G012307 | 5.3 | 0.2 | G012307 | NA | NA |
| G012317 | 3.5 | 0.6 | G012317 | 3.5 | 0.7 |
| G012260 | 1.9 | 0.6 | G012260 | 1.8 | 0.1 |
| G012254 | 1.6 | 0.2 | G012254 | 0.7 | 0.3 |
| G012266 | 1.0 | 0.1 | G012266 | 1.9 | 0.6 |
| G012256 | 0.8 | 0.4 | G012256 | 0.2 | 0 |
| G012274 | 0.8 | 0.1 | G012274 | 0.7 | 0.1 |
| G012259 | 0.6 | 0.1 | G012259 | 0.6 | 0.1 |
| G012262 | 0.5 | 0.1 | G012262 | 0.6 | 0.2 |
| G012276 | 0.5 | 0.0 | G012276 | 0.8 | NA |
| G012257 | 0.4 | 0.1 | G012257 | 0.1 | 0 |
| G012277 | 0.4 | 0.1 | G012277 | 0.4 | 0.1 |
| G012261 | 0.2 | 0.1 | G012261 | 0.2 | 0.1 |
| G012270 | 0.2 | 0.1 | G012270 | 0.1 | 0 |
| G012255 | 0.1 | 0.1 | G012255 | 0.1 | 0.1 |
| G012258 | 0.1 | 0.0 | G012258 | 0.1 | 0.1 |
| G012263 | 0.1 | 0.0 | G012263 | 0.1 | 0 |
| G012264 | 0.1 | 0.0 | G012264 | 0.2 | 0.1 |
| G012265 | 0.1 | 0.0 | G012265 | 0.1 | 0 |
| G012267 | 0.1 | 0.0 | G012267 | 0.2 | 0.1 |
| G012268 | 0.1 | 0.0 | G012268 | 0.1 | 0.1 |
| G012269 | 0.1 | 0.0 | G012269 | 0.1 | 0.1 |
| G012272 | 0.1 | 0.1 | G012272 | 0.1 | 0 |
| G012273 | 0.1 | 0.1 | G012273 | 0.1 | 0.1 |
| G012275 | 0.1 | 0.0 | G012275 | 0.2 | 0.1 |
| G012278 | 0.1 | 0.0 | G012278 | 0.1 | 0.1 |
| G012279 | 0.0 | 0.0 | G012279 | 0.1 | 0.1 |
| G012271 | NA | NA | G012271 | 0.1 | 0 |

*"selected dgRNA", a subset of the tested guide RNAs

TABLE 8B

KLKB1 editing data for sgRNAs delivered to primary cynomolgus hepatocytes: Sets 1 & 2

| | SET 1 | | | SET 2 | |
|---|---|---|---|---|---|
| GUIDE ID | Avg % Edit | Std Dev % Edit | GUIDE ID | Avg % Edit | Std Dev % Edit |
| G000644 | 35.9 | 3.5 | G000644 | 37.4 | 2.3 |
| G000645 | 64.1 | 0.2 | G000645 | 65 | 0.1 |
| G009246 | 92.7 | 1.2 | G009246 | 93 | 0.9 |
| G009267 | 84 | 1.6 | G009267 | 83.3 | 1.9 |
| G009285 | 82.5 | 0.3 | G009285 | 80.7 | 0.7 |
| G009321 | 46.8 | 17 | G009321 | 46.3 | 12.8 |
| G012102 | 91.4 | 0.5 | G012102 | 92.4 | 0.1 |
| G012144 | 45.3 | 0.6 | G012144 | 45.4 | 4.2 |
| G012253* | 92 | 0.3 | G012253* | 90.4 | 1.3 |
| G012254 | 2.3 | 0.1 | G012254* | 2.8 | 0.1 |
| G012255 | 0 | 0 | G012255 | 0.1 | 0 |
| G012256 | 0.1 | 0 | G012256 | 0.1 | 0 |
| G012257 | 0.1 | 0 | G012257 | 0.2 | 0 |
| G012258 | NA | NA | G012258 | 0.1 | 0.1 |
| G012259 | 0.3 | 0.1 | G012259 | 0.3 | 0.1 |
| G012260 | 0.6 | 0 | G012260* | 0.8 | 0.1 |
| G012261 | 0.2 | 0.1 | G012261 | 0.2 | 0.1 |
| G012262 | 0.3 | 0.2 | G012262 | 0.4 | 0.1 |
| G012263 | 0.2 | 0.1 | G012263 | 0.2 | 0.1 |
| G012264 | 0.1 | 0 | G012264 | 0.1 | 0 |
| G012265 | NA | NA | G012265 | 0.1 | 0 |
| G012266 | 0.3 | 0.1 | G012266 | 0.3 | 0.1 |
| G012267 | 0.2 | 0.1 | G012267 | 0.1 | 0 |
| G012268 | 0.1 | 0.1 | G012268 | 0.1 | 0 |
| G012269 | 0.1 | 0 | G012269 | 0.1 | 0 |
| G012270 | NA | NA | G012270* | 4.8 | 0.7 |
| G012271 | 0.2 | 0.1 | G012271 | 0 | 0 |
| G012274 | NA | NA | G012274 | 0.6 | 0.2 |
| G012277 | 0.6 | 0.1 | G012277 | 0.6 | 0 |
| G012278 | 0 | 0 | G012278 | 0.2 | 0.1 |
| G012279 | 0.2 | 0.1 | G012279 | 0.1 | 0 |
| G012280* | 42.2 | 1.6 | G012280* | 39.1 | 5.6 |
| G012282* | 8.8 | 0.3 | G012282* | 10.3 | NA |
| G012283* | 50.5 | NA | G012283* | 53.7 | 3.2 |
| G012284 | 0.3 | 0.2 | G012284 | 0.2 | 0 |
| G012285* | 30.2 | 4.9 | G012285* | 30.5 | 0.8 |
| G012287 | 0.1 | 0 | G012287 | 0.1 | 0 |
| G012291 | 5.5 | 0.8 | G012291* | 4.8 | 1.3 |
| G012292 | 6.4 | 0.3 | G012292* | 6.3 | 0.7 |
| G012293* | 86.6 | 0.1 | G012293* | 83.3 | 6.8 |
| G012294* | 53.6 | 1.5 | G012294* | 52.1 | 0.3 |
| G012295* | 6.7 | 0.1 | G012295* | 7 | 0.8 |
| G012296* | 51.4 | 2.1 | G012296* | 49 | 3.4 |
| G012297 | NA | NA | G012297* | 41.9 | 0.4 |
| G012299* | 38.2 | 0.9 | G012299 | NA | NA |
| G012300* | 28.5 | 4.6 | G012300 | NA | NA |
| G012301* | 7.6 | 2 | G012301 | NA | NA |
| G012302* | 39.9 | 2.8 | G012302 | NA | NA |
| G012303 | 13.8 | 1.1 | G012303 | NA | NA |
| G012304* | 69.7 | 2.8 | G012304 | NA | NA |
| G012305* | 16 | 0.1 | G012305 | NA | NA |
| G012307 | 0.3 | 0.2 | G012307 | NA | NA |
| G012308* | 57.7 | 3.9 | G012308* | 58.1 | 0.7 |
| G012309* | 55.9 | 7.3 | G012309* | 55.1 | 3.7 |
| G012310* | 27 | 2.3 | G012310* | 27 | 1.9 |
| G012311 | 4 | 0.1 | G012311* | 3.6 | 1.8 |
| G012312* | 14.4 | 0.5 | G012312* | 14.7 | 0.3 |

*"selected sgRNA", a subset of the tested guide RNAs 2.2. Screening of sgRNA in Primary Human Hepatocytes (PHH), Editing and Protein Knockdown Three PHH lots (Hu8296, Hu8300, and Hu8284) were individually plated as described in Example 1 and incubated at 37° C., 5% CO2 for 24 hours prior to lipofection. A mixture of 6.88 μL of 10 μM sgRNA guide and 4.5 μL of 500 ng/μl Cas9 mRNA was prepared in a total volume of 11.4 μl water. A lipofection reagent as described in Example 1 was thawed to room temperature. The guide/Cas9 mRNA mix was sequentially added with 4.8 μL of 50 mM sodium citrate/200 mM NaCl (pH 5), 4.8 μL of lipofection reagent, and 54 µL of molecular grade water, to prepare a total volume 75 µL per sample. The lipofection sample was pre-incubated with media, William's E or Cellartis® Power Primary HEP Medium (Takara Bio, Cat. Y20020), containing 3% FBS or cynomolgus serum for 10 min at 37° C. prior to addition to cells. Cells were transfected with 10 µL of prepared lipofection sample containing 300 ng of Cas9 mRNA and 302 ng guide sgRNA.

The cells were lysed 72 hours post-transfection, and NGS analysis was conducted as described in Example 1.

For cells to be utilized for secreted protein analysis by ELISA or intracellular protein analysis by western blotting, at 72 hours post-transfection the media was aspirated and replaced with Cellartis® Power Primary HEP Medium (Takara Bio, Cat. Y20020). Media were aspirated and replaced every two days. For samples used to determine reduction of secreted protein, media were aspirated from wells and replaced with fresh media which was incubated for 24-48 hrs prior to harvest. Media were collected and transferred to 96-well PCR plates and stored at −20° C. prior to use in assays.

Figure 3A:
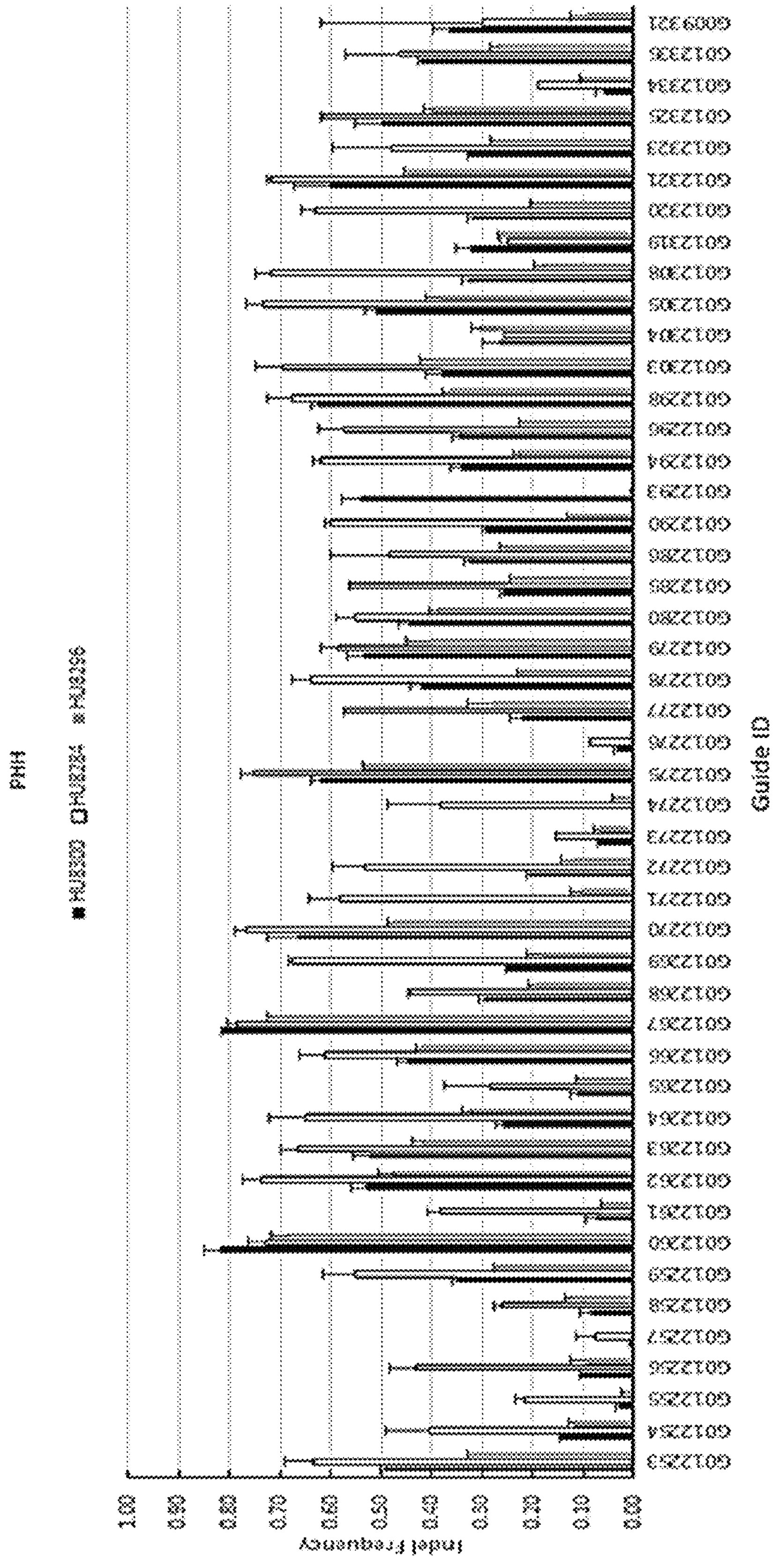
FIGS. 3A-3E show percent editing (indel frequency) (FIG. 3A), secreted KLKB1 protein levels (FIG. 3B), and correlation plots (FIGS. 3C-E), after transfection of PHH with KLKB1-targeting guide RNAs in three different PHH lots (HU8300, HU8284, and HU8296).
Figure 3B:
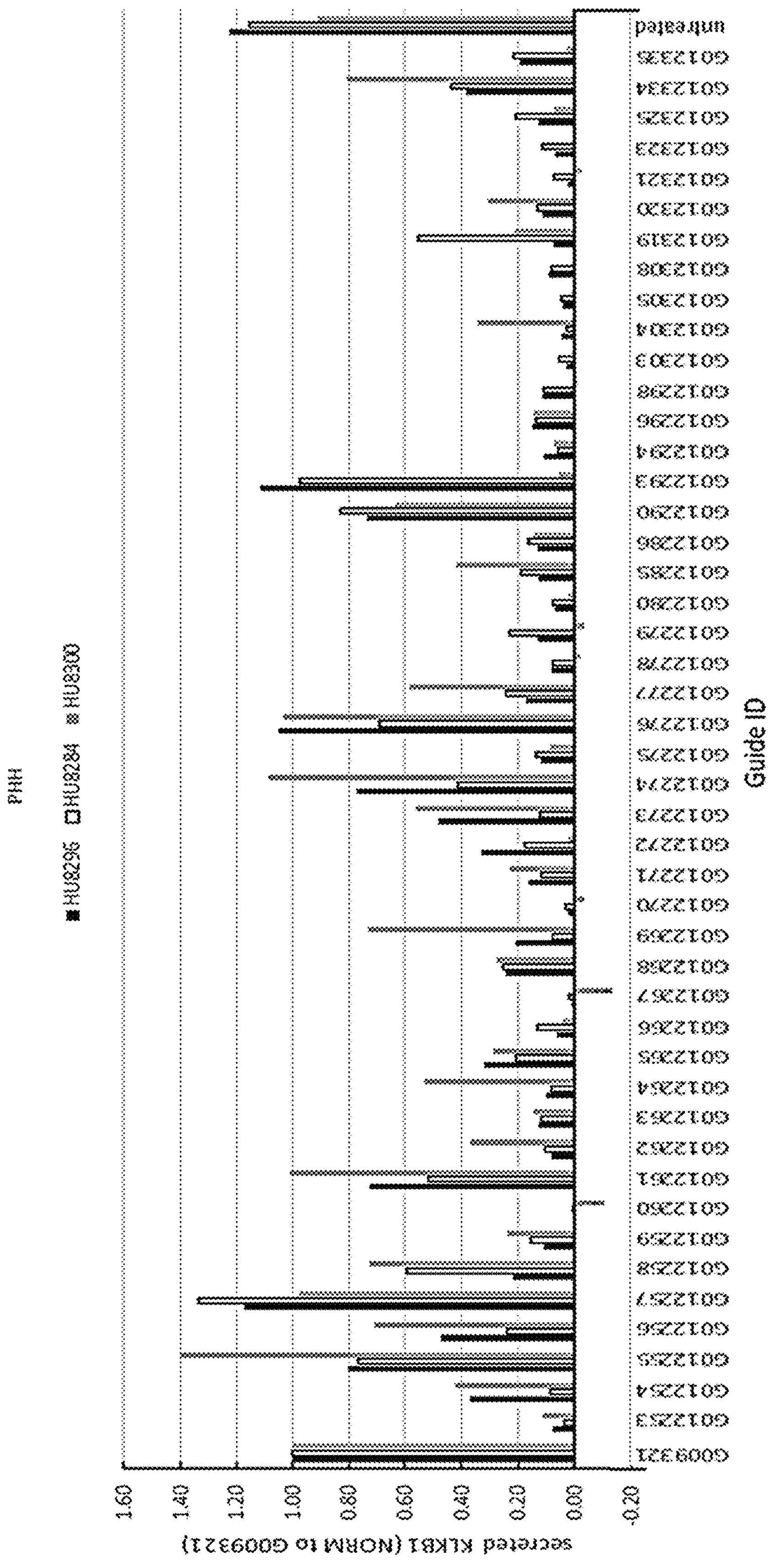
Figure 3C:
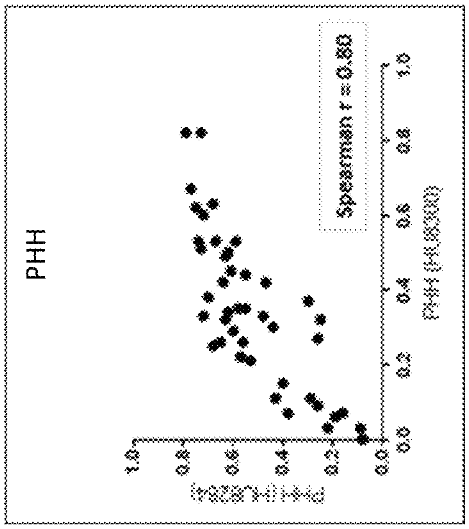
Figure 3D:
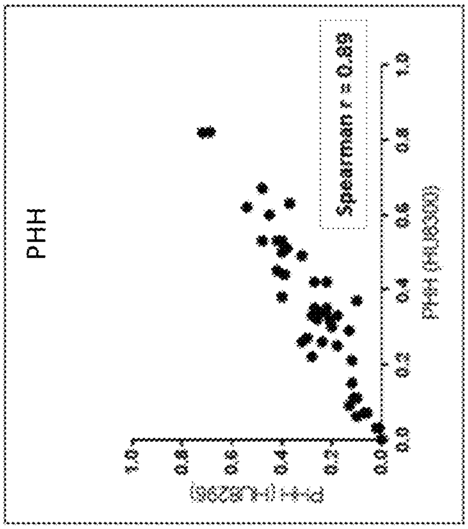
Figure 3E:
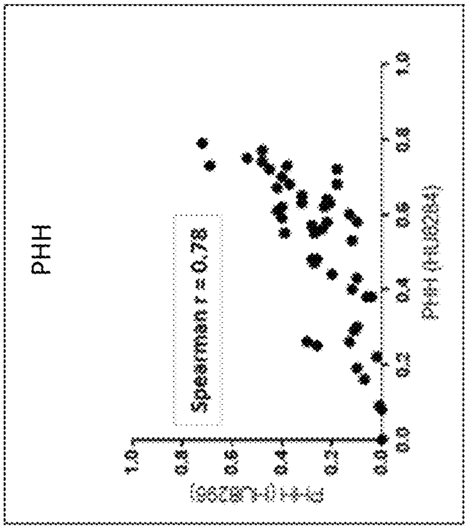

Table 8C and FIGS. 3A-3B show percent editing and secreted KLKB1 protein levels based on transfection of three PHH lots. Twenty guides were compared in pairs of PHH lots, and determined to be highly correlated (Spearman R>0.8) as shown in FIGS. 3C-3E.

TABLE 8C

KLKB1 indel frequency and secreted KLKB1 protein levels in PHH

| | PHH Lot 1-HU8296 | | | | PHH Lot 2-HU8284 | | | | PHH Lot 3-HU8300 | | | |
|---|---|---|---|---|---|---|---|---|---|---|---|---|
| GUIDE ID | Indel Freq | SD | Secreted KLKB1 | SD | Indel Freq | SD | Secreted KLKB1 | SD | Indel Freq | SD | Secreted KLKB1 | SD |
| G012253 | 0.32 | 0.01 | 1.54 | 0.03 | 0.63 | 0.06 | 0.24 | 0.00 | 0.49 | 0.01 | 0.43 | 0.11 |
| G012254 | 0.12 | 0.01 | 7.22 | 0.33 | 0.40 | 0.09 | 0.57 | 0.05 | 0.15 | 0.00 | 1.61 | 0.06 |
| G012255 | 0.02 | 0.00 | 15.72 | 0.70 | 0.22 | 0.02 | 5.05 | 0.26 | 0.03 | 0.01 | 5.33 | 0.08 |
| G012256 | 0.10 | 0.03 | 9.26 | 0.13 | 0.43 | 0.05 | 1.57 | 0.31 | 0.11 | 0.00 | 2.69 | 0.07 |
| G012257 | 0.00 | 0.00 | 22.99 | 0.45 | 0.08 | 0.04 | 8.75 | 0.28 | 0.00 | 0.00 | 3.71 | 0.21 |
| G012258 | 0.13 | 0.01 | 4.24 | 0.02 | 0.26 | 0.02 | 3.89 | 0.03 | 0.09 | 0.02 | 2.76 | 0.00 |
| G012259 | 0.27 | 0.01 | 2.18 | 0.01 | 0.55 | 0.07 | 1.02 | 0.01 | 0.35 | 0.01 | 0.91 | 0.13 |
| G012260 | 0.69 | 0.03 | 0.07 | 0.02 | 0.73 | 0.03 | 0.05 | 0.01 | 0.82 | 0.03 | −0.50 | 0.01 |
| G012261 | 0.06 | 0.00 | 14.26 | 0.77 | 0.38 | 0.03 | 3.39 | 0.11 | 0.07 | 0.02 | 3.84 | 0.28 |
| G012262 | 0.48 | 0.03 | 1.65 | 0.05 | 0.74 | 0.04 | 0.68 | 0.09 | 0.53 | 0.03 | 1.40 | 0.10 |
| G012263 | 0.42 | 0.02 | 2.48 | 0.06 | 0.67 | 0.03 | 0.78 | 0.02 | 0.53 | 0.03 | 0.55 | 0.16 |
| G012264 | 0.32 | 0.02 | 1.97 | 0.02 | 0.65 | 0.07 | 0.54 | 0.03 | 0.26 | 0.01 | 2.02 | 0.09 |
| G012265 | 0.11 | 0.00 | 6.24 | 0.02 | 0.29 | 0.09 | 1.36 | 0.10 | 0.11 | 0.01 | 1.10 | 0.03 |
| G012266 | 0.42 | 0.01 | 1.30 | 0.02 | 0.61 | 0.05 | 0.87 | 0.03 | 0.45 | 0.02 | 0.15 | 0.02 |
| G012267 | 0.72 | 0.00 | 0.23 | 0.02 | 0.79 | 0.02 | 0.14 | 0.00 | 0.82 | 0.00 | −0.52 | 0.01 |
| G012268 | 0.20 | 0.01 | 4.78 | 0.14 | 0.44 | 0.01 | 1.65 | 0.06 | 0.30 | 0.01 | 1.05 | 0.03 |
| G012269 | 0.18 | 0.03 | 4.10 | 0.06 | 0.68 | 0.01 | 0.52 | 0.07 | 0.25 | 0.00 | 2.79 | 0.04 |
| G012270 | 0.48 | 0.01 | 0.46 | 0.02 | 0.77 | 0.02 | 0.21 | 0.00 | 0.67 | 0.06 | −0.13 | 0.04 |
| G012271 | 0.10 | 0.02 | 3.16 | 0.02 | 0.58 | 0.06 | 0.79 | 0.04 | ND | 0.00 | 0.87 | 0.05 |
| G012272 | 0.12 | 0.02 | 6.42 | 0.09 | 0.53 | 0.06 | 1.16 | 0.03 | 0.21 | 0.01 | 0.09 | 0.02 |
| G012273 | 0.07 | 0.01 | 9.39 | 0.03 | 0.16 | ND | 0.82 | 0.04 | 0.07 | 0.00 | 2.14 | 0.06 |
| G012274 | 0.04 | 0.00 | 15.14 | 0.43 | 0.38 | 0.11 | 2.73 | 0.03 | ND | 0.00 | 4.13 | 0.04 |
| G012275 | 0.54 | 0.00 | 2.35 | 0.02 | 0.75 | 0.03 | 0.89 | 0.00 | 0.62 | 0.02 | 0.33 | 0.00 |
| G012276 | 0.01 | 0.00 | 20.54 | 0.24 | 0.09 | 0.00 | 4.56 | 0.18 | 0.03 | 0.00 | 3.92 | 0.03 |
| G012277 | 0.28 | 0.05 | 3.39 | 0.08 | 0.57 | 0.00 | 1.61 | 0.01 | 0.22 | 0.03 | 2.22 | 0.01 |
| G012278 | 0.22 | 0.01 | 1.61 | 0.03 | 0.64 | 0.04 | 0.50 | 0.00 | 0.42 | 0.02 | −0.08 | 0.01 |
| G012279 | 0.40 | 0.05 | 2.56 | 0.08 | 0.59 | 0.03 | 1.51 | 0.02 | 0.53 | 0.03 | −0.12 | 0.01 |
| G012280 | 0.39 | 0.02 | 1.34 | 0.06 | 0.55 | 0.04 | 0.52 | 0.01 | 0.44 | 0.02 | 0.08 | 0.00 |
| G012285 | 0.24 | 0.00 | 2.53 | 0.01 | 0.56 | ND | 1.23 | 0.06 | 0.26 | 0.00 | 1.60 | 0.06 |
| G012286 | 0.26 | 0.01 | 2.56 | 0.05 | 0.48 | 0.12 | 1.06 | 0.01 | 0.33 | 0.01 | 0.55 | 0.02 |
| G012290 | 0.13 | 0.00 | 14.44 | 0.06 | 0.60 | 0.01 | 5.45 | 0.06 | 0.29 | 0.00 | 2.41 | 0.04 |
| G012293 | 0.00 | 0.00 | 21.78 | 0.26 | 0.00 | 0.00 | 6.39 | 0.02 | 0.54 | 0.04 | 0.21 | 0.02 |
| G012294 | 0.23 | 0.01 | 2.12 | 0.16 | 0.62 | 0.02 | 0.39 | 0.06 | 0.34 | 0.02 | 0.29 | 0.08 |
| G012296 | 0.22 | 0.00 | 2.89 | 0.11 | 0.58 | 0.05 | 0.90 | 0.04 | 0.35 | 0.01 | 0.55 | 0.04 |
| G012298 | 0.37 | 0.01 | 2.19 | 0.01 | 0.68 | 0.05 | 0.72 | 0.03 | 0.63 | 0.01 | −0.04 | 0.00 |
| G012303 | 0.40 | 0.03 | 0.52 | 0.02 | 0.70 | 0.05 | 0.38 | 0.00 | 0.38 | 0.03 | 0.04 | 0.00 |
| G012304 | 0.30 | 0.02 | 0.89 | 0.09 | 0.26 | ND | 0.20 | 0.01 | 0.27 | 0.03 | 1.31 | 0.06 |
| G012305 | 0.38 | 0.03 | 0.79 | 0.07 | 0.73 | 0.03 | 0.32 | 0.01 | 0.51 | 0.02 | 0.04 | 0.00 |
| G012308 | 0.18 | 0.02 | 1.79 | 0.13 | 0.72 | 0.03 | 0.53 | 0.04 | 0.33 | 0.01 | −0.03 | 0.01 |
| G012319 | 0.26 | 0.00 | 1.45 | 0.03 | 0.25 | 0.02 | 3.62 | 0.76 | 0.32 | 0.03 | 0.80 | 0.00 |
| G012320 | 0.21 | 0.00 | 2.24 | 0.11 | 0.63 | 0.03 | 0.88 | 0.01 | 0.32 | 0.01 | 1.17 | 0.02 |
| G012321 | 0.45 | 0.00 | 0.49 | 0.07 | 0.72 | 0.01 | 0.49 | 0.09 | 0.60 | 0.07 | −0.09 | 0.02 |
| G012323 | 0.28 | 0.00 | 1.32 | 0.01 | 0.48 | 0.12 | 0.75 | 0.17 | 0.33 | 0.00 | 0.01 | 0.02 |
| G012325 | 0.40 | 0.02 | 2.51 | 0.01 | 0.62 | 0.00 | 1.37 | 0.68 | 0.50 | 0.05 | 0.27 | 0.02 |
| G012334 | 0.10 | 0.00 | 7.52 | 0.18 | 0.19 | ND | 2.86 | 0.14 | 0.06 | 0.02 | 3.07 | 0.19 |
| G012335 | 0.27 | 0.02 | 3.78 | 0.26 | 0.47 | 0.10 | 1.42 | 0.09 | 0.42 | 0.01 | 0.11 | 0.02 |
| G009321 (HOX9) | 0.10 | 0.03 | 19.59 | 1.30 | 0.30 | 0.32 | 6.57 | 0.00 | 0.37 | 0.03 | 3.80 | 0.11 |
| Untreated | | | 24.03 | 0.03 | | | 7.58 | 0.10 | | | 3.47 | 0.03 |

2.3. Screening of sgRNAs in PHH

Primary human hepatocytes (PHHs) were transfected with Cas9 mRNA and sgRNA as described in Example 1. The cells were lysed 72 hours post transfection and NGS analysis was conducted as described in Example 1.

Figure 4A:
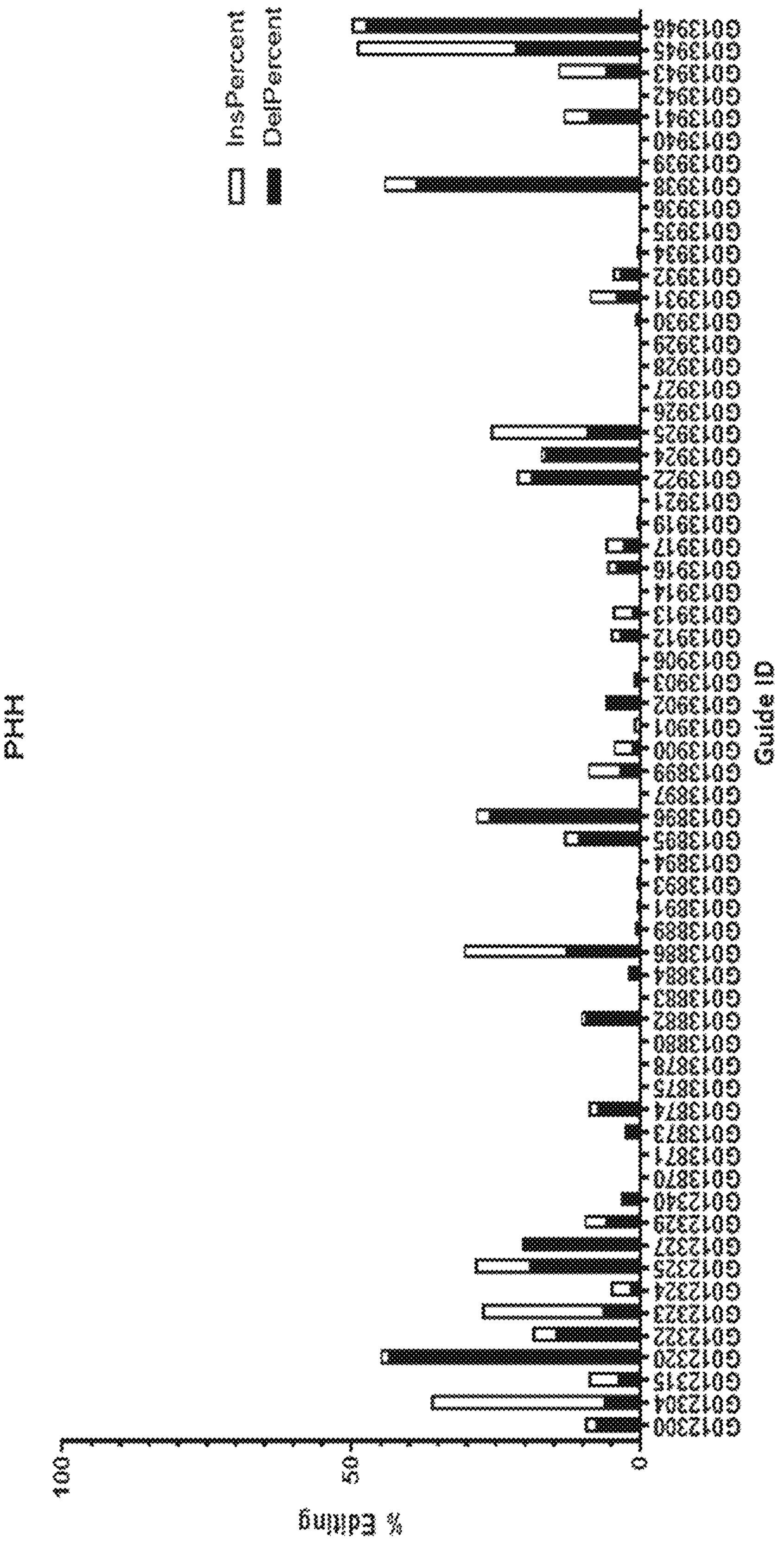
FIGS. 4A-4D show percent editing of the KLKB1 guides in primary human hepatocytes (PHH) (FIGS. 4A-4B), and percent editing of the KLKB1 guides in primary cynomolgus hepatocytes (PCH) (FIGS. 4C-4D).
Figure 4B:
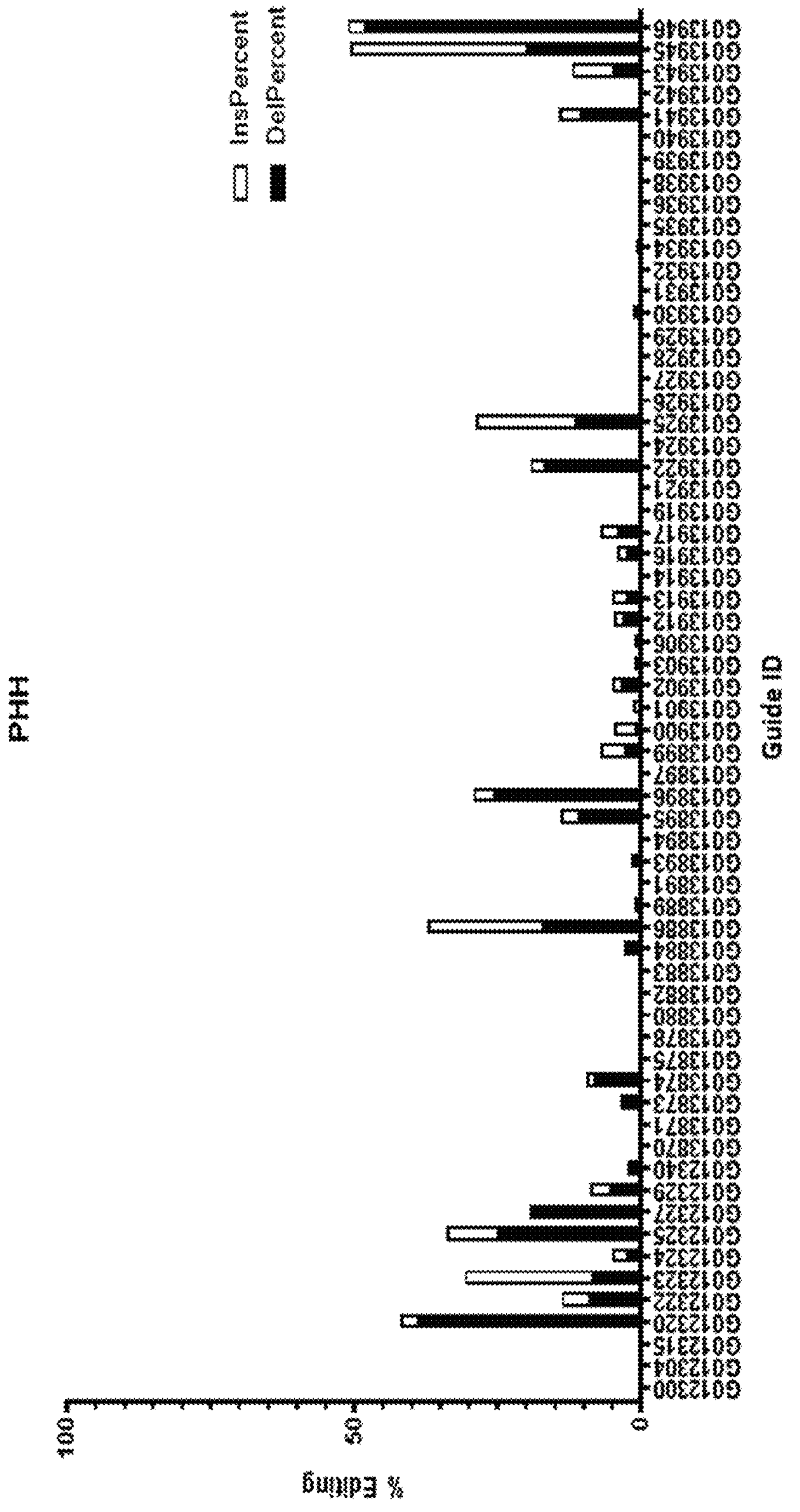

Percent editing was determined for sgRNAs comprising guide sequences of Table 1 for two primer sets. The average percent editing for each guide in the two data sets is shown in Table 9A and FIGS. 4A-4B.

TABLE 9A

KLKB1 editing data in primary human hepatocytes

| | Set 1 | | | | Set 2 | | |
|---|---|---|---|---|---|---|---|
| Guide ID | % Editing | SD | N | Guide ID | % Editing | SD | N |
| G013946* | 49.9 | 2.2 | 2 | G013946 | 50.8 | 9.1 | 2 |
| G000644 | 49.3 | 5.7 | 2 | G000644 | 44.7 | 3.7 | 2 |
| G013945* | 48.6 | 1.9 | 2 | G013945* | 50.3 | 1.6 | 2 |
| G012102 | 48.1 | 4.4 | 2 | G012102 | 45.8 | 0.3 | 2 |
| G012320* | 45 | 14 | 2 | G012320* | 41.9 | 15 | 2 |
| G013938* | 44.5 | 9.5 | 2 | G013938 | ND | NA | 2 |
| G009285 | 42.1 | 0.7 | 2 | G009285 | 41.4 | 4.9 | 2 |
| G009246 | 40.5 | 0.6 | 2 | G009246 | 39.1 | 3.1 | 2 |
| G000502 | 36.5 | 15 | 2 | G000502 | 34.9 | 18 | 2 |
| G000502 | 36.5 | 15 | 2 | G000502 | 34.9 | 18.4 | 2 |
| G012304* | 36.2 | 3.3 | 2 | G012304 | ND | NA | 2 |
| G013886* | 30.5 | 4 | 2 | G013886* | 37.2 | 0.8 | 2 |
| G012325* | 28.7 | 3.3 | 2 | G012325* | 33.9 | 0.9 | 2 |
| G013896* | 28.4 | 3.7 | 2 | G013896* | 28.7 | 1.2 | 2 |
| G009321 | 27.7 | 10 | 2 | G009321 | 26.9 | 11 | 2 |
| G012323* | 27.4 | 7.2 | 2 | G012323* | 30.6 | 6.5 | 2 |
| G013925* | 25.9 | 11 | 2 | G013925* | 28.7 | 12 | 2 |
| G013922* | 21 | 7 | 2 | G013922* | 19.3 | 3.3 | 2 |
| G012327 | 20.5 | 2.3 | 2 | G012327* | 19.5 | 4.6 | 2 |
| G012322 | 18.6 | 3.8 | 2 | G012322 | 13.9 | 4.5 | 2 |
| G009267 | 18.3 | 1.9 | 2 | G009267 | 20.4 | 4.8 | 2 |
| G013924* | 17.4 | 9.3 | 2 | G013924 | ND | NA | 2 |
| G013943* | 14.2 | 9.5 | 2 | G013943* | 12.1 | 6.1 | 2 |
| G000645 | 13.5 | 3.2 | 2 | G000645 | 9.1 | 4 | 2 |
| G013895* | 13.4 | 3.1 | 2 | G013895 | 14 | 6.6 | 2 |
| G013941* | 13 | 4.8 | 2 | G013941 | 14.3 | 2.6 | 2 |
| G013882* | 10.4 | 8.1 | 2 | G013882 | ND | NA | 2 |
| G012329* | 9.8 | 0.7 | 2 | G012329* | 8.9 | 0.9 | 2 |
| G012300* | 9.7 | 1.8 | 2 | G012300 | ND | NA | 2 |
| G013899 | 9.3 | 0.2 | 2 | G013899* | 7.1 | 4.4 | 2 |
| G013874 | 9 | 2.3 | 2 | G013874* | 9.5 | 3.6 | 2 |
| G013931 | 8.9 | 1.6 | 2 | G013931 | ND | NA | 2 |
| G012315 | 8.8 | 5.4 | 2 | G012315 | ND | NA | 2 |
| G013902 | 6.2 | 3.9 | 2 | G013902* | 4.9 | 5.2 | 2 |
| G013917 | 6.1 | 4.6 | 2 | G013917* | 7.1 | 6.5 | 2 |
| G013916 | 5.6 | 0.6 | 2 | G013916 | 4 | 0.8 | 2 |
| G012324 | 5.2 | 2.9 | 2 | G012324 | 4.8 | 3.9 | 2 |
| G013912 | 5.1 | 2.9 | 2 | G013912 | 4.6 | 1.1 | 2 |
| G013913 | 4.8 | 0.4 | 2 | G013913* | 5 | 0.2 | 2 |
| G013932 | 4.8 | 4.9 | 2 | G013932 | ND | NA | 2 |
| G013900 | 4.6 | 2.1 | 2 | G013900 | 4.6 | 0.7 | 2 |
| G012340 | 3.3 | 1.1 | 2 | G012340 | 2.2 | 1.7 | 2 |
| G013873 | 2.8 | 0.8 | 2 | G013873 | 3.6 | 1.1 | 2 |
| G013884 | 2.3 | 1.1 | 2 | G013884 | 3 | 0.3 | 2 |
| G013903 | 1.4 | 0.4 | 2 | G013903 | 1.3 | 0.5 | 2 |
| G013901 | 1.2 | 1.3 | 2 | G013901 | 1.4 | 1.3 | 2 |
| G013889 | 0.9 | 0.2 | 2 | G013889 | 1.1 | 1.2 | 2 |
| G013930 | 0.9 | 1.1 | 2 | G013930 | 1.3 | 0.1 | 2 |
| G013893 | 0.8 | 0.3 | 2 | G013893 | 1.8 | 0.4 | 2 |
| G013919 | 0.8 | 0.2 | 2 | G013919 | 0.6 | 0.4 | 2 |
| G013891 | 0.7 | 0.1 | 2 | G013891 | 0.3 | 0 | 2 |
| G013934 | 0.6 | 0.2 | 2 | G013934 | 0.9 | 1.1 | 2 |
| G013894 | 0.3 | 0.4 | 2 | G013894 | 0.6 | 0.8 | 2 |
| G013906 | 0.3 | 0 | 2 | G013906 | 0.7 | 0.3 | 2 |
| G013914 | 0.3 | 0.1 | 2 | G013914 | ND | NA | 2 |
| G013928 | 0.3 | 0.2 | 2 | G013928 | 0.5 | NA | 2 |
| G013875 | 0.2 | 0.1 | 2 | G013875 | 0.3 | 0.1 | 2 |
| G013878 | 0.2 | 0.1 | 2 | G013878 | 0.3 | 0.1 | 2 |
| G013880 | 0.2 | 0.1 | 2 | G013880 | 0.1 | 0 | 2 |
| G013939 | 0.2 | 0.2 | 2 | G013939 | 0.2 | 0.1 | 2 |
| G013942 | 0.2 | 0.1 | 2 | G013942 | 0.2 | 0.1 | 2 |

TABLE 9A-continued

KLKB1 editing data in primary human hepatocytes

| | Set 1 | | | | Set 2 | | |
|---|---|---|---|---|---|---|---|
| Guide ID | % Editing | SD | N | Guide ID | % Editing | SD | N |
| G013870 | 0.1 | 0 | 2 | G013870 | 0.1 | 0 | 2 |
| G013871 | 0.1 | 0 | 2 | G013871 | 0.1 | 0 | 2 |
| G013883 | 0.1 | 0 | 2 | G013883 | 0.6 | 0.4 | 2 |
| G013897 | 0.1 | 0 | 2 | G013897 | 0.1 | 0 | 2 |
| G013927 | 0.1 | 0 | 2 | G013927 | 0 | 0 | 2 |
| G013929 | 0.1 | 0 | 2 | G013929 | ND | NA | 2 |
| G013935 | 0.1 | 0.1 | 2 | G013935 | 0.1 | 0 | 2 |
| G013936 | 0.1 | 0 | 2 | G013936 | 0.1 | 0 | 2 |
| G013940 | 0.1 | 0 | 2 | G013940 | 0.1 | 0.1 | 2 |
| G013921 | ND | ND | 2 | G013921 | 0.3 | 0.2 | 2 |
| G013926 | ND | ND | 2 | G013926 | 0.2 | 0.1 | 2 |

Figure 4C:
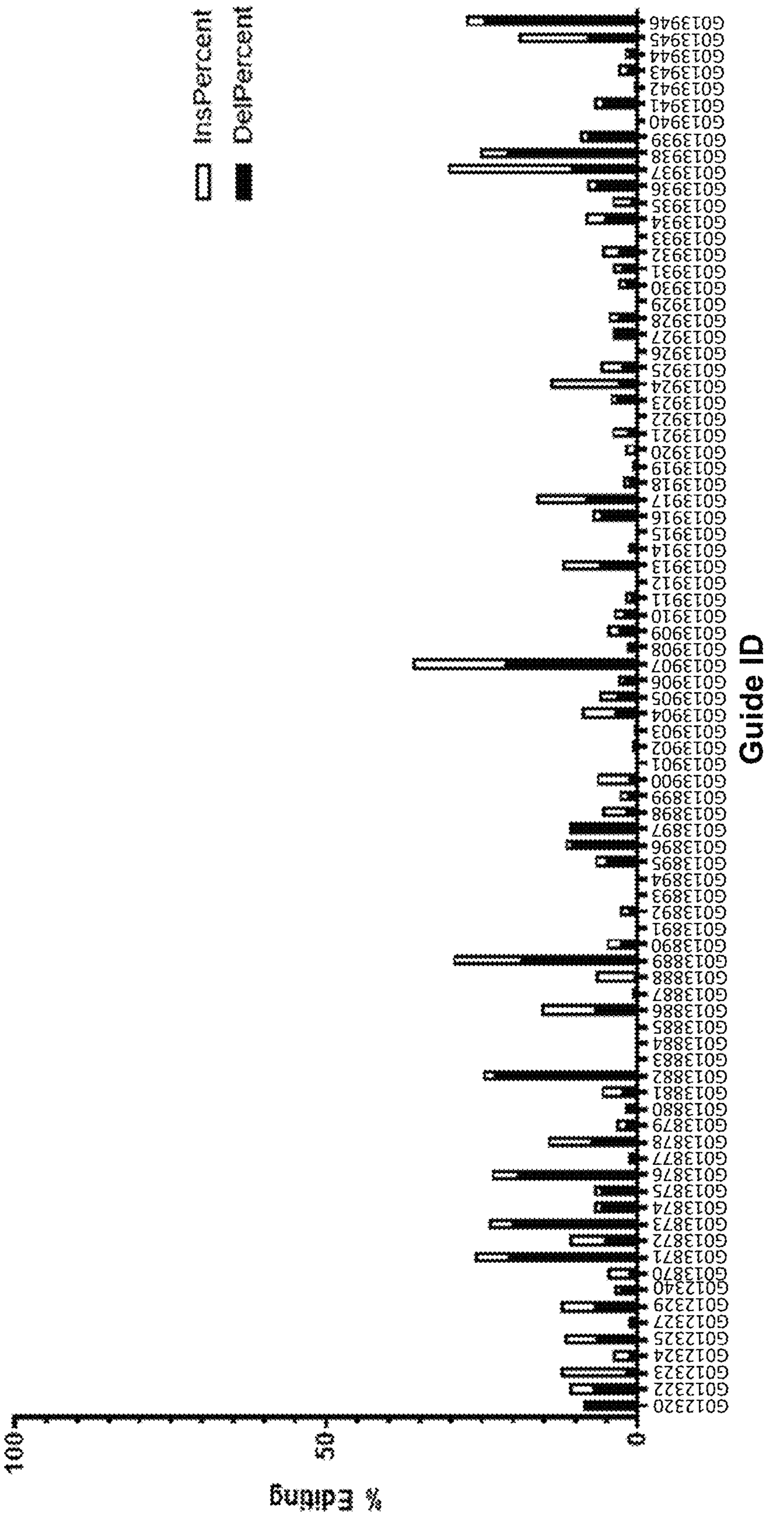
Figure 4D:
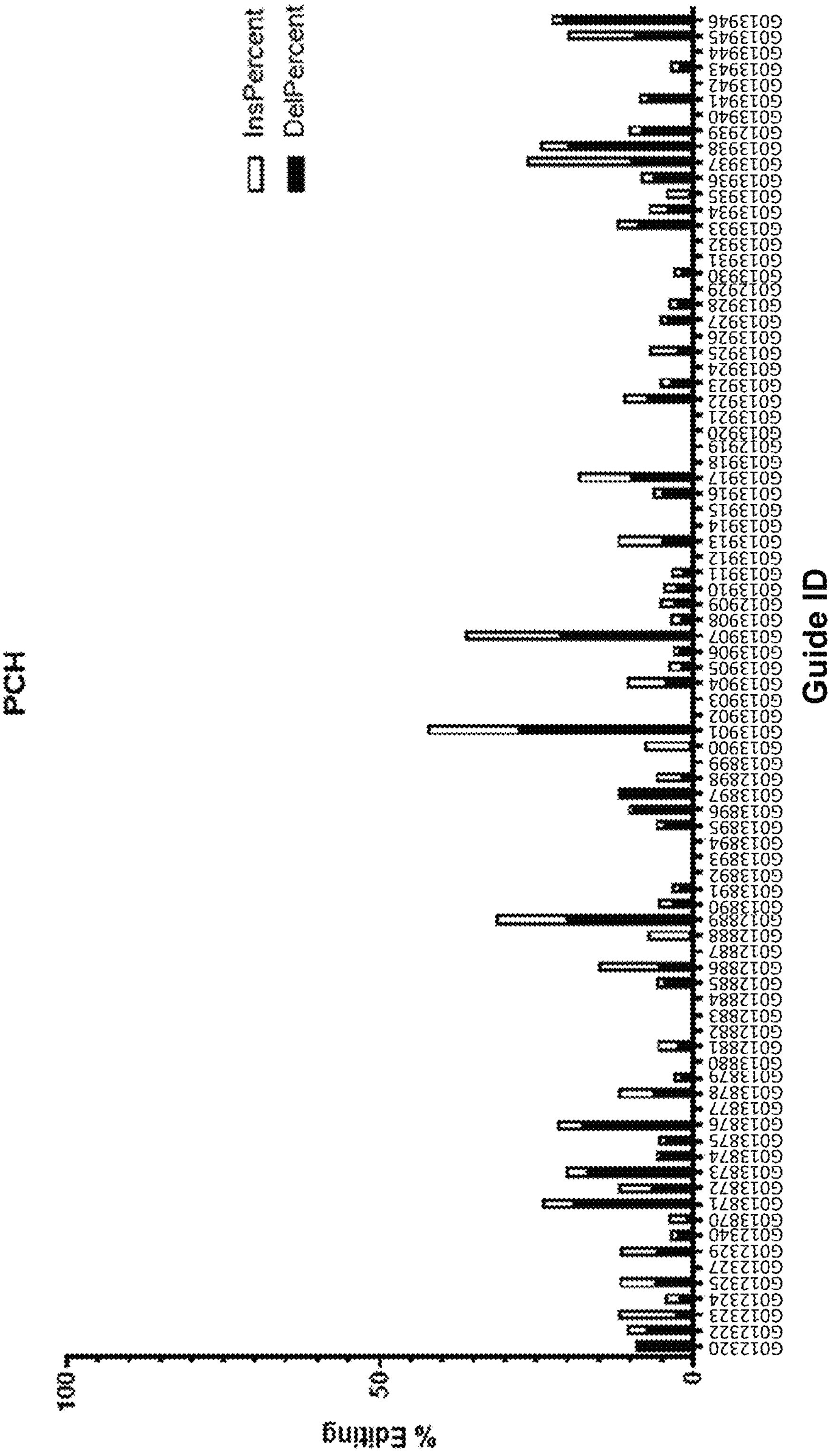

*"selected sgRNA", a subset of the tested guide RNAs 2.3.1 Screening of sgRNAs in PCH Primary cynomolgus hepatocytes (PCHs) were transfected with Cas9 mRNA and sgRNA as described in Example 1 using increasing amounts of prepared lipofection sample to assay a dose responsive effect. The cells were lysed 72 hours post transfection and NGS analysis was conducted as described in Example 1. Percent editing was determined for sgRNAs comprising guide sequences in Table 1 using two primer sets for amplification and detection of indels. The average percent editing for each guide in the two data sets is shown in Table 9B and FIGS. 4C-4D.

The selected guide RNAs and corresponding editing data from Sets 1 and 2 are marked with an asterisk (*) in Table 9B. When compared the datasets were determined to be highly correlated (Spearman R=0.987).

TABLE 9B

KLKB1 editing data in primary cynomolgus hepatocytes

| | Set 1 | | | Set 2 | | |
|---|---|---|---|---|---|---|
| Guide ID | % Editing | SD | N | % Editing | SD | N |
| G013923 | 4.3 | 0 | 2 | 5 | 0.6 | 2 |
| G013877 | 1.5 | 0 | 2 | 1.3 | 0.2 | 2 |
| G013884 | 0.4 | 0 | 2 | 0.2 | 0.1 | 2 |
| G013929 | 0.3 | 0 | 2 | 0.5 | 0.1 | 2 |
| G013940 | 0.2 | 0 | 2 | 0.3 | 0.1 | 2 |
| G013915 | 0.1 | 0 | 2 | 0.2 | ND | 2 |
| G013939 | 9.3 | 0.1 | 2 | 10.1 | 0.3 | 2 |
| G013870 | 4.8 | 0.1 | 2 | 4 | 1 | 2 |
| G013879 | 3.4 | 0.1 | 2 | 3.1 | 0.6 | 2 |
| G012327 | 1.4 | 0.1 | 2 | 1.5 | 0.1 | 2 |
| G013942 | 0.7 | 0.1 | 2 | 0.2 | ND | 2 |
| G013883 | 0.3 | 0.1 | 2 | 0.2 | 0.1 | 2 |
| G013926 | 0.1 | 0.1 | 2 | 0 | 0 | 2 |
| G013887 | 0.9 | 0.2 | 2 | 0.7 | 0.7 | 2 |
| G013930 | 3.1 | 0.3 | 2 | 3.2 | 1.3 | 2 |
| G013902 | 0.9 | 0.3 | 2 | 0.7 | 0.4 | 2 |
| G013903 | 0.7 | 0.3 | 2 | 0.9 | 0.1 | 2 |
| G013875 | 6.8 | 0.4 | 2 | 5.6 | 0.2 | 2 |
| G013881 | 5.8 | 0.4 | 2 | 5.7 | 0 | 2 |
| G013914 | 1.4 | 0.4 | 2 | ND | ND | 2 |
| G013936 | 8.2 | 0.6 | 2 | 8.1 | 1.3 | 2 |
| G013916 | 7.1 | 0.6 | 2 | 6.4 | 1.9 | 2 |
| G013874 | 6.9 | 0.6 | 2 | 6 | 0.4 | 2 |
| G012340 | 3.6 | 0.6 | 2 | 3.7 | 0.9 | 2 |
| G013880 | 1.9 | 0.6 | 2 | 1.9 | 0.1 | 2 |
| G013919 | 0.9 | 0.6 | 2 | 0.7 | 0.4 | 2 |
| G013878* | 14.3 | 0.7 | 2 | 11.8 | 3 | 2 |
| G013931 | 4 | 0.8 | 2 | ND | ND | 2 |
| G013872 | 11.1 | 0.9 | 2 | 11.7 | 1 | 2 |
| G013909 | 4.8 | 0.9 | 2 | 5.3 | 0.5 | 2 |
| G013899 | 3 | 0.9 | 2 | 3 | 1.6 | 2 |

TABLE 9B-continued

KLKB1 editing data in primary cynomolgus hepatocytes

| Guide ID | Set 1 % Editing | Set 1 SD | Set 1 N | Set 2 % Editing | Set 2 SD | Set 2 N |
|---|---|---|---|---|---|---|
| G013886* | 15.4 | 1.1 | 2 | 15.2 | 0.4 | 2 |
| G013944 | 2.1 | 1.1 | 2 | 2.3 | 0.5 | 2 |
| G013876* | 23.4 | 1.3 | 2 | 21.4 | 3.3 | 2 |
| G013921 | 4.1 | 1.3 | 2 | 3.1 | 3.3 | 2 |
| G013913* | 12.1 | 1.5 | 2 | 11.8 | ND | 2 |
| G013871* | 25.9 | 1.6 | 2 | 23.9 | 4 | 2 |
| G013904 | 9 | 1.6 | 2 | 10.4 | 2.3 | 2 |
| G013906 | 3.2 | 1.6 | 2 | 3.3 | 1.9 | 2 |
| G013928 | 4.6 | 1.7 | 2 | 4.1 | 1.6 | 2 |
| G012324 | 3.9 | 1.8 | 2 | 4.4 | 2.4 | 2 |
| G013910 | 3.9 | 1.8 | 2 | 4.8 | 1.8 | 2 |
| G013892 | 2.7 | 1.8 | 2 | 2.8 | 1.8 | 2 |
| G013943 | 3.1 | 2 | 2 | 3.7 | 2.3 | 2 |
| G013920 | 2 | 2 | 2 | 2.9 | 1.4 | 2 |
| G013889* | 29.4 | 2.1 | 2 | 31.4 | 0.5 | 2 |
| G013938* | 24.9 | 2.1 | 2 | 24.2 | 0.6 | 2 |
| G012329* | 12.4 | 2.1 | 2 | 11.4 | 0.5 | 2 |
| G012315 | 4.1 | 2.1 | 2 | ND | ND | 2 |
| G013927 | 4 | 2.1 | 2 | 5.2 | 0.3 | 2 |
| G013918 | 2.3 | 2.1 | 2 | 2 | 1.6 | 2 |
| G013935 | 4.1 | 2.2 | 2 | 4.3 | 1.1 | 2 |
| G013941 | 7 | 2.3 | 2 | 8.7 | 1.3 | 2 |
| G012322 | 10.8 | 2.4 | 2 | 10.4 | 3.4 | 2 |
| G013890 | 4.9 | 2.5 | 2 | 5.5 | 2.1 | 2 |
| G013925 | 5.8 | 2.6 | 2 | 6.9 | 2.3 | 2 |
| G012325* | 11.8 | 2.8 | 2 | 11.6 | 3.4 | 2 |
| G013888 | 6.7 | 2.8 | 2 | 7.1 | 1.6 | 2 |
| G013897 | 11 | 3 | 2 | 11.9 | 1.6 | 2 |
| G013900 | 6.6 | 3 | 2 | 7.7 | 4.2 | 2 |
| G013917* | 16.4 | 3.2 | 2 | 18.3 | 3.8 | 2 |
| G013937* | 30.4 | 3.8 | 2 | 26.5 | 6 | 2 |
| G013932 | 5.6 | 4.4 | 2 | ND | ND | 2 |
| G012304* | 11.7 | 4.7 | 2 | ND | ND | 2 |
| G013895 | 6.8 | 4.7 | 2 | 6 | 3.2 | 2 |
| G013896* | 11.5 | 5 | 2 | 10.3 | 3.8 | 2 |
| G013907* | 36.1 | 5.5 | 2 | 36.2 | 5.7 | 2 |
| G012320 | 8.9 | 5.7 | 2 | 9.2 | 4.6 | 2 |
| G013945* | 19 | 6.6 | 2 | 20 | 6.1 | 2 |
| G013924* | 13.9 | 6.7 | 2 | ND | ND | 2 |
| G013882* | 24.7 | 9 | 2 | ND | ND | 2 |
| G013946* | 27.2 | ND | 2 | 22.4 | 4.2 | 2 |
| G013873* | 23.6 | ND | 2 | 20.1 | 2.9 | 2 |
| G012323* | 12.3 | ND | 2 | 11.8 | 1.5 | 2 |
| G013934 | 8.3 | ND | 2 | 7.1 | 1.6 | 2 |
| G013905 | 6 | ND | 2 | 4 | 3.3 | 2 |
| G013898 | 5.7 | ND | 2 | 6 | 2.1 | 2 |
| G013908 | 1.8 | ND | 2 | 3.6 | 1.3 | 2 |
| G013911 | 1.8 | ND | 2 | 3.4 | 1.6 | 2 |
| G013894 | 0.3 | ND | 2 | 0.2 | 0.1 | 2 |
| G013885 | ND | ND | 2 | 5.9 | 0.2 | 2 |
| G013891 | ND | ND | 2 | 3.3 | 0.7 | 2 |
| G013893 | ND | ND | 2 | 1.2 | 0.9 | 2 |
| G013901 | ND | ND | 2 | 42.2 | 4.2 | 2 |
| G013912 | ND | ND | 2 | 0.4 | ND | 2 |
| G013922 | ND | ND | 2 | 11.2 | 1.1 | 2 |
| G013933 | ND | ND | 2 | 12.2 | 4 | 2 |

*"selected sgRNA", a subset of the tested guide RNAs

Example 3: Dose Response Assays

3.1 Cross Screening of sgRNAs in PCH and PHH in 4-Point Dose Response Assays Modified sgRNAs targeting human KLKB1 and the cynomolgus-matched sgRNA sequences were tested in PITH and PCH in a dose response assay, using 16 guides from the PITH guide screen described in Example 2.2. Lipofection samples including Cas9 mRNA and sgRNAs were prepared as described in Example 2.2. Primary human and cynomolgus hepatocytes were plated as described in Example 1. Both cell lines were incubated at 37° C., 5% CO2 for 48 hours prior to treatment with lipofection samples. Lipofection samples were incubated in Cellartis® Power Primary HEP Medium (Takara Bio, Cat. Y20020) containing 3% FBS at 37° C. for 10 minutes.

Post incubation, the lipofection samples were added to the human or cynomolgus hepatocytes in a 4-point dose response assay. The PITH were lysed 120 hours post-transfection and the PCH were lysed 168 hrs post-transfection and gDNAs were subjected to quantified PCR for NGS analysis as described in Example 1.

Figure 5A:
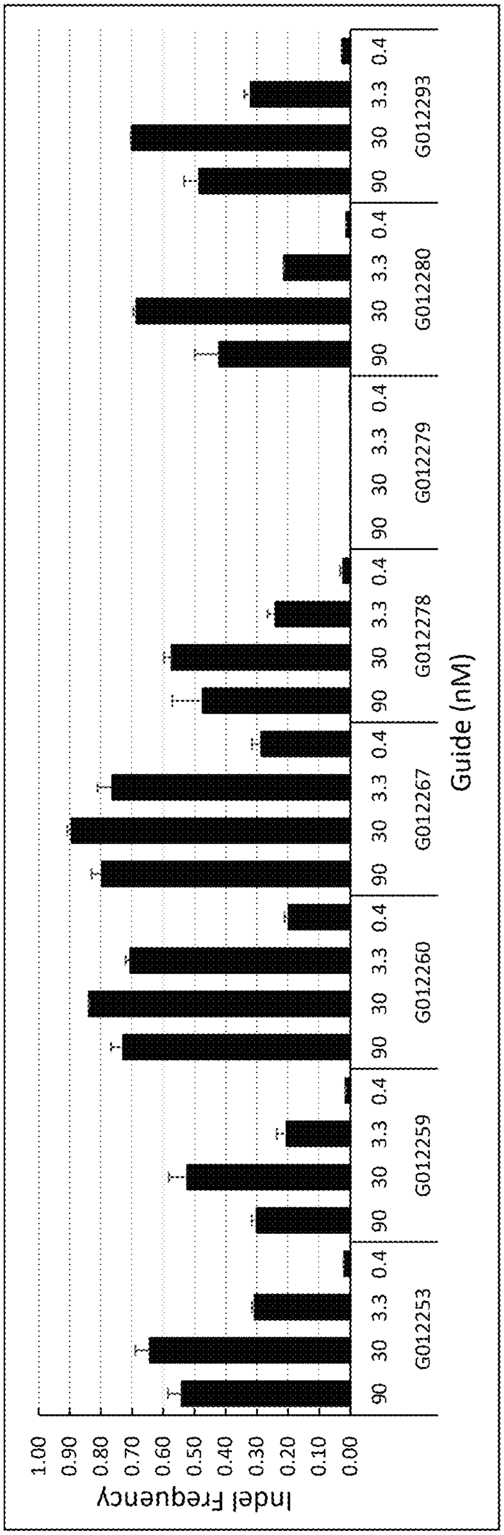
FIGS. 5A-5J show dose response data for percent editing and secreted kallikrein for certain guide sequences in PHH (FIGS. 5A-5D) and PCH (FIGS. 5E-5H), and correlation plots of percent editing and secreted protein in PHH and PCH (FIGS. 5I-5J).
Figure 5B:
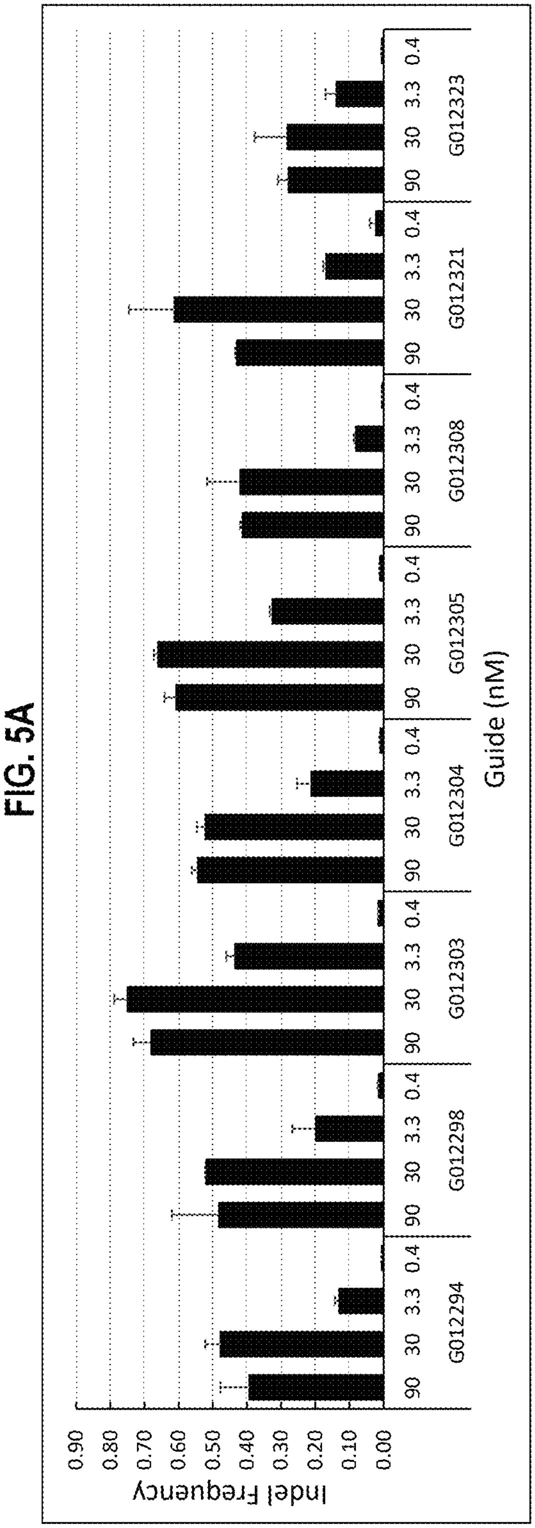
Figure 5C:
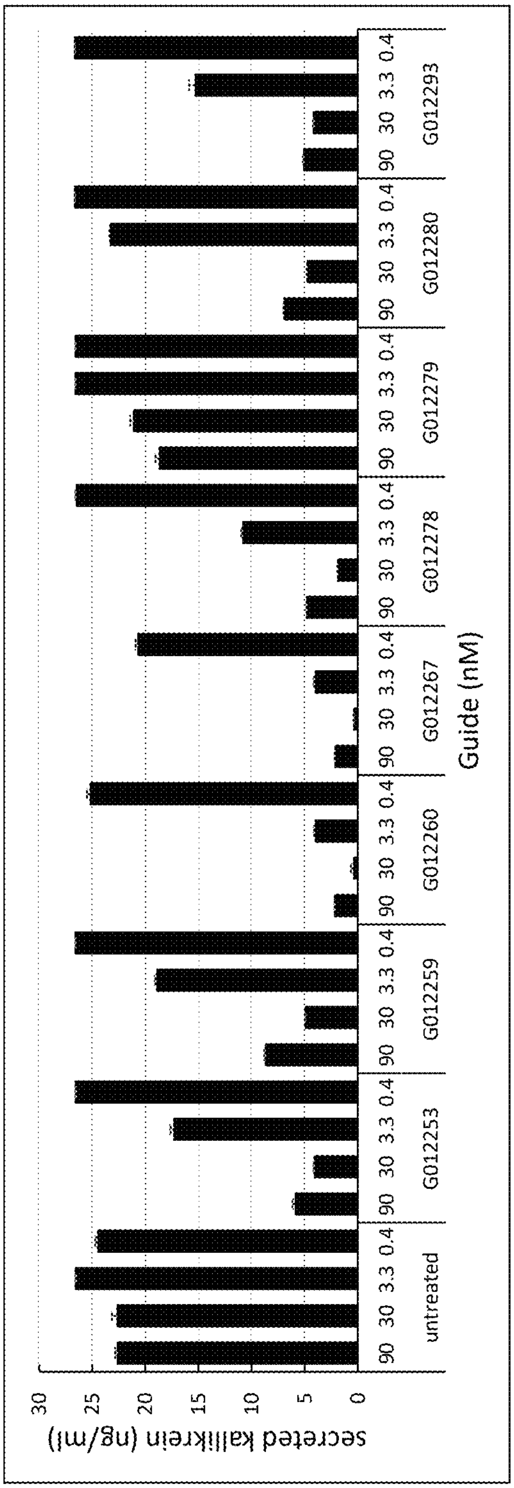
Figure 5D:
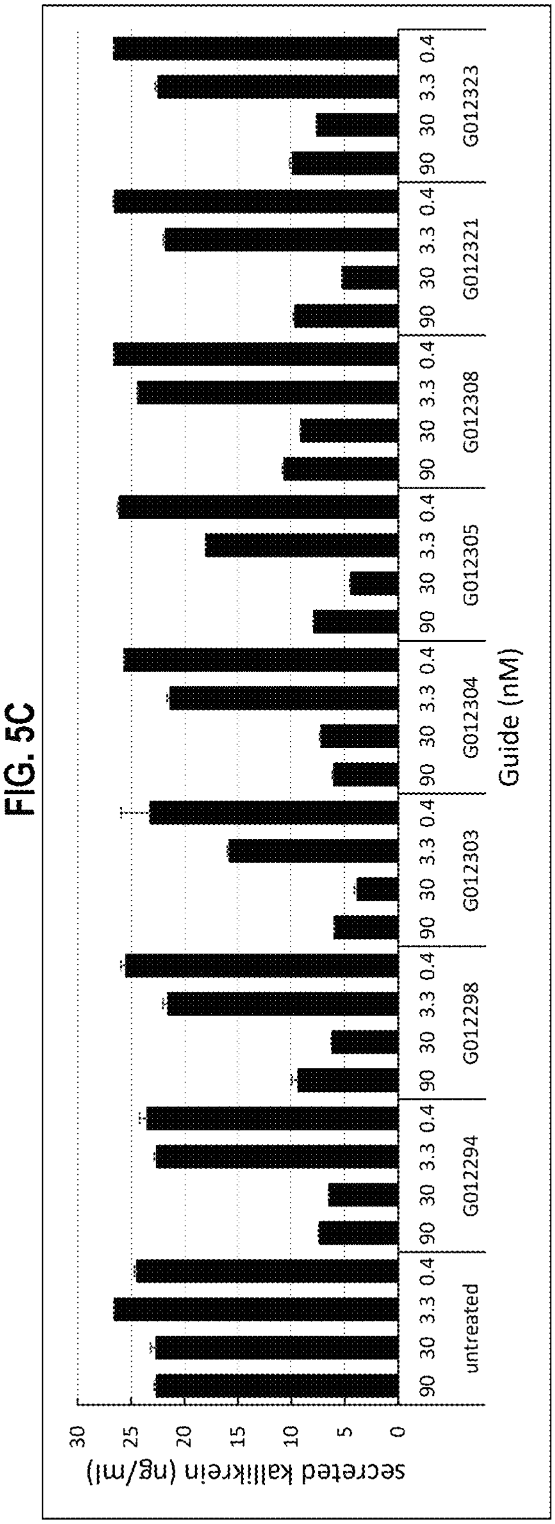

The indel frequency of sgRNAs at concentrations of 0.4 nM, 3.3 nM, 30 nM, and 90 nM in PITH cells is shown in Table 10 and FIGS. 5A-51B. Secreted KLKB1 protein levels of the sgRNAs determined by ELISA is shown in Table 10 and FIGS. 5C-5D.

TABLE 10

KLKB1 editing data and secreted KLKB1 protein levels in PHH

| GUIDE ID | Guide concentration (nM) | Avg Indel Freq | SD | Avg secreted KLKB1 | SD |
|---|---|---|---|---|---|
| G012253 | 90 | 0.54 | 0.04 | 5.84 | 0.29 |
| | 30 | 0.64 | 0.05 | 4.06 | 0.09 |
| | 3.3 | 0.31 | 0.01 | 17.29 | 0.35 |
| | 0.4 | 0.02 | 0.00 | 26.56 | 0.00 |
| G012259 | 90 | 0.30 | 0.02 | 8.70 | 0.10 |
| | 30 | 0.52 | 0.06 | 4.90 | 0.00 |
| | 3.3 | 0.20 | 0.03 | 18.90 | 0.20 |
| | 0.4 | 0.02 | 0.00 | 26.60 | 0.00 |
| G012260 | 90 | 0.73 | 0.04 | 2.20 | 0.00 |
| | 30 | 0.84 | 0.00 | 0.30 | 0.30 |
| | 3.3 | 0.71 | 0.02 | 4.00 | 0.20 |
| | 0.4 | 0.20 | 0.01 | 25.10 | 0.30 |
| G012267 | 90 | 0.80 | 0.03 | 2.10 | 0.10 |
| | 30 | 0.89 | 0.01 | 0.30 | 0.00 |
| | 3.3 | 0.76 | 0.05 | 4.00 | 0.20 |
| | 0.4 | 0.29 | 0.03 | 20.70 | 0.20 |
| G012278 | 90 | 0.47 | 0.10 | 4.80 | 0.10 |
| | 30 | 0.57 | 0.02 | 1.80 | 0.10 |
| | 3.3 | 0.24 | 0.02 | 10.80 | 0.10 |
| | 0.4 | 0.02 | 0.01 | 26.50 | 0.10 |
| G012279 | 90 | 0.00 | 0.00 | 18.70 | 0.40 |
| | 30 | 0.00 | 0.00 | 21.10 | 0.30 |
| | 3.3 | 0.00 | 0.00 | 26.60 | 0.00 |
| | 0.4 | 0.00 | 0.00 | 26.60 | 0.00 |
| G012280 | 90 | 0.42 | 0.08 | 6.90 | 0.10 |
| | 30 | 0.69 | 0.01 | 4.70 | 0.10 |
| | 3.3 | 0.21 | 0.00 | 23.30 | 0.10 |
| | 0.4 | 0.01 | 0.00 | 26.60 | 0.00 |
| G012293 | 90 | 0.48 | 0.05 | 5.10 | 0.10 |
| | 30 | 0.70 | 0.00 | 4.20 | 0.00 |
| | 3.3 | 0.32 | 0.02 | 15.20 | 0.60 |
| | 0.4 | 0.03 | 0.00 | 26.60 | 0.00 |
| G012294 | 90 | 0.39 | 0.08 | 7.37 | 0.08 |
| | 30 | 0.48 | 0.04 | 6.44 | 0.06 |
| | 3.3 | 0.13 | 0.01 | 22.57 | 0.25 |
| | 0.4 | 0.01 | 0.00 | 23.49 | 0.73 |
| G012298 | 90 | 0.48 | 0.14 | 9.30 | 0.60 |
| | 30 | 0.52 | 0.00 | 6.20 | 0.10 |
| | 3.3 | 0.20 | 0.07 | 21.50 | 0.50 |
| | 0.4 | 0.01 | 0.00 | 25.50 | 0.50 |
| G012303 | 90 | 0.68 | 0.05 | 6.00 | 0.00 |
| | 30 | 0.75 | 0.04 | 3.80 | 0.30 |
| | 3.3 | 0.43 | 0.03 | 15.80 | 0.20 |
| | 0.4 | 0.02 | 0.00 | 23.20 | 2.70 |
| G012304 | 90 | 0.54 | 0.02 | 6.00 | 0.10 |
| | 30 | 0.52 | 0.02 | 7.20 | 0.20 |
| | 3.3 | 0.21 | 0.04 | 21.30 | 0.30 |
| | 0.4 | 0.01 | 0.00 | 25.60 | 0.00 |
| G012305 | 90 | 0.61 | 0.03 | 7.90 | 0.00 |
| | 30 | 0.66 | 0.01 | 4.40 | 0.10 |

TABLE 10-continued

KLKB1 editing data and secreted KLKB1 protein levels in PHH

| GUIDE ID | Guide concentration (nM) | Avg Indel Freq | SD | Avg secreted KLKB1 | SD |
|---|---|---|---|---|---|
| | 3.3 | 0.33 | 0.01 | 18.00 | 0.00 |
| | 0.4 | 0.01 | 0.00 | 26.10 | 0.20 |
| G012308 | 90 | 0.41 | 0.01 | 10.70 | 0.20 |
| | 30 | 0.42 | 0.10 | 9.10 | 0.10 |
| | 3.3 | 0.08 | 0.01 | 24.30 | 0.10 |
| | 0.4 | 0.01 | 0.00 | 26.60 | 0.00 |
| G012321 | 90 | 0.43 | 0.00 | 9.70 | 0.10 |
| | 30 | 0.61 | 0.13 | 5.20 | 0.00 |
| | 3.3 | 0.17 | 0.01 | 21.70 | 0.20 |
| | 0.4 | 0.02 | 0.02 | 26.50 | 0.10 |
| G012323 | 90 | 0.28 | 0.03 | 9.90 | 0.30 |
| | 30 | 0.28 | 0.10 | 7.60 | 0.10 |
| | 3.3 | 0.14 | 0.03 | 22.40 | 0.30 |
| | 0.4 | 0.01 | 0.00 | 26.60 | 0.00 |
| untreated | NA | | | 22.61 | 0.21 |

Figure 5E:
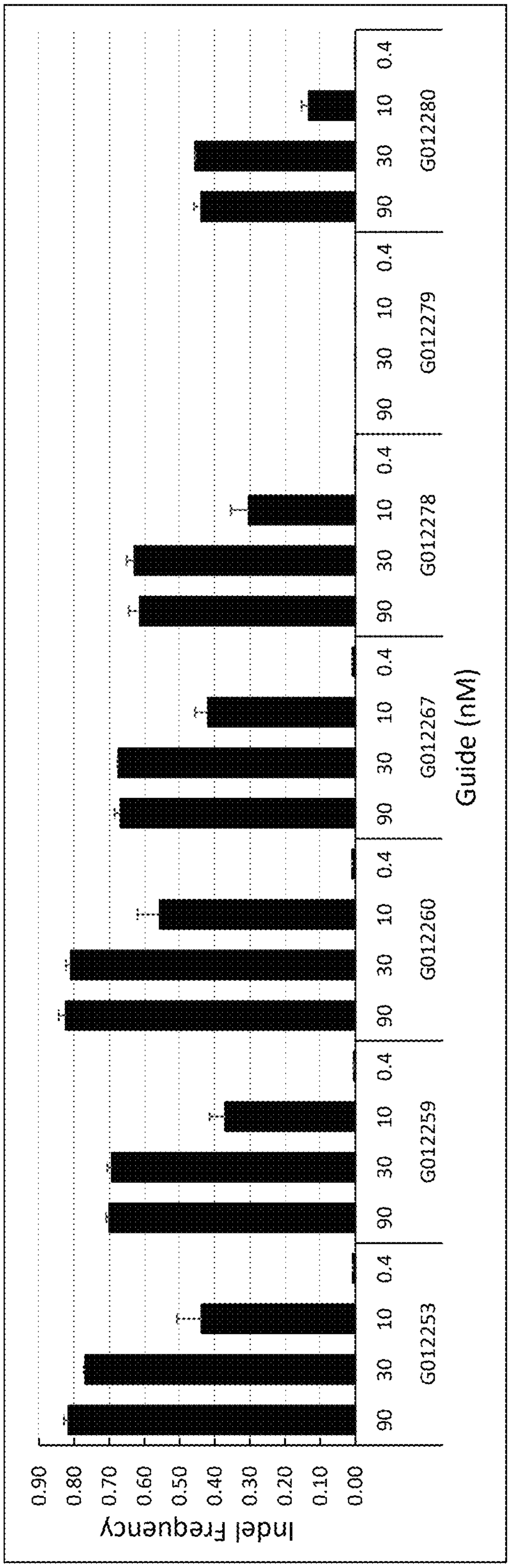
Figure 5F:
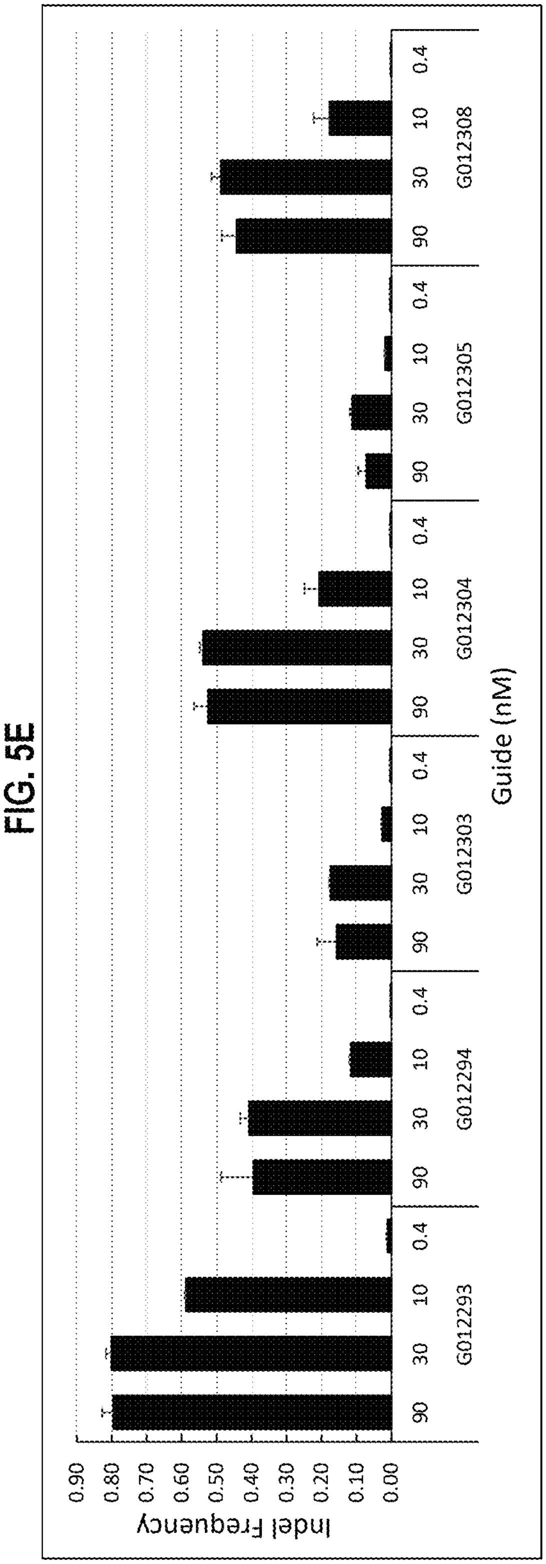
Figure 5G:
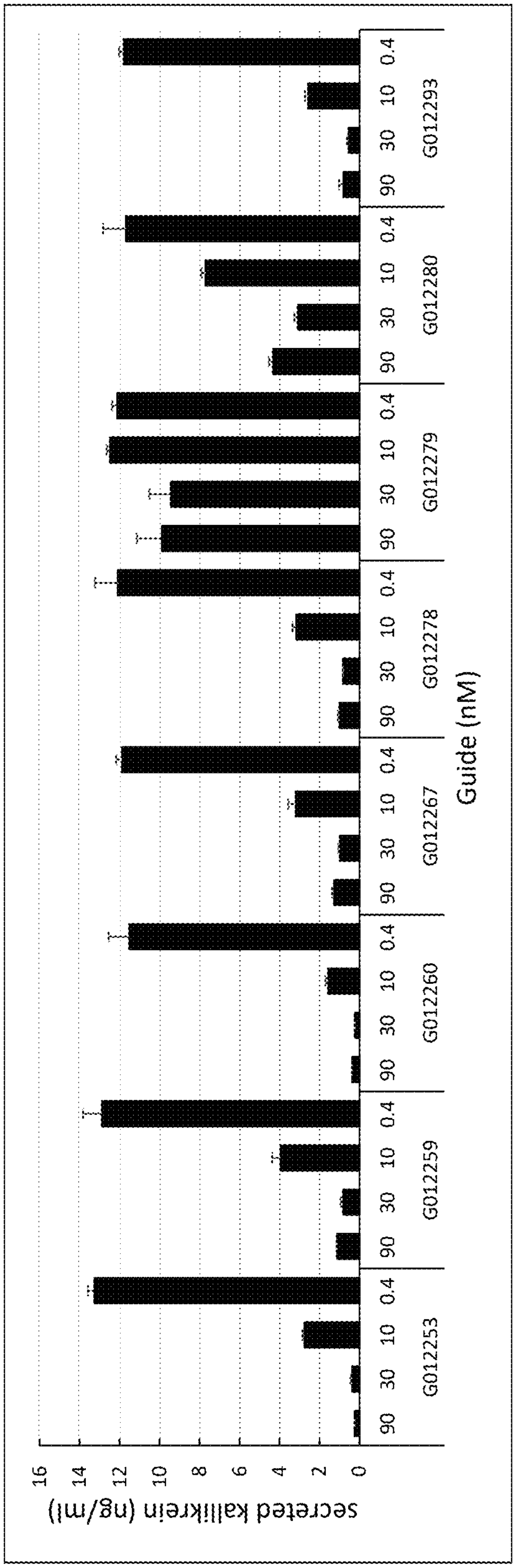
Figure 5H:
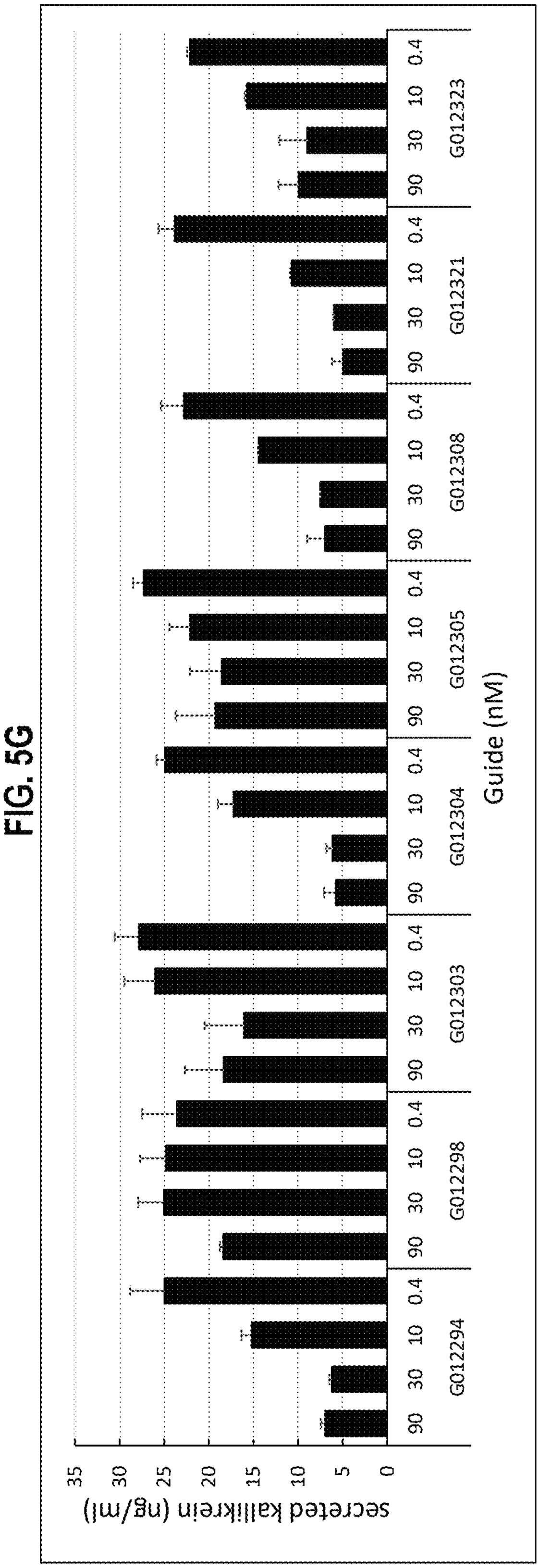

The indel frequency of sgRNAs at concentrations of 0.4 nM, 10 nM, 30 nM, and 90 nM in PCH cells is shown in Table 11 and FIGS. 5E-5F. Secreted KLKB1 protein levels of the sgRNAs determined by ELISA is shown in Table 11 and FIGS. 5G-5H.

TABLE 11

KLKB1 editing data and secreted KLKB1 protein levels in PCH

| guide | Guide concentration (nM) | Mean Indel Freq | SD | Mean secreted KLKB1 | SD |
|---|---|---|---|---|---|
| G012253 | 90 | 0.25 | 0.01 | 0.82 | 0.01 |
| | 30 | 0.38 | 0.05 | 0.77 | 0.00 |
| | 10 | 2.76 | 0.09 | 0.44 | 0.07 |
| | 0.4 | 13.26 | 0.32 | 0.01 | 0.00 |
| G012259 | 90 | 1.13 | 0.02 | 0.70 | 0.01 |
| | 30 | 0.81 | 0.12 | 0.69 | 0.01 |
| | 10 | 3.95 | 0.41 | 0.37 | 0.04 |
| | 0.4 | 12.88 | 0.96 | 0.00 | 0.00 |
| G012260 | 90 | 0.36 | 0.02 | 0.82 | 0.02 |
| | 30 | 0.23 | 0.00 | 0.81 | 0.01 |
| | 10 | 1.56 | 0.13 | 0.56 | 0.06 |
| | 0.4 | 11.51 | 1.03 | 0.01 | 0.00 |
| G012267 | 90 | 1.28 | 0.10 | 0.67 | 0.02 |
| | 30 | 0.98 | 0.07 | 0.67 | 0.00 |
| | 10 | 3.18 | 0.37 | 0.42 | 0.04 |
| | 0.4 | 11.88 | 0.28 | 0.01 | 0.00 |
| G012278 | 90 | 1.01 | 0.06 | 0.61 | 0.03 |
| | 30 | 0.82 | 0.01 | 0.63 | 0.02 |
| | 10 | 3.16 | 0.19 | 0.30 | 0.05 |
| | 0.4 | 12.08 | 1.14 | 0.00 | 0.00 |
| G012279 | 90 | 9.88 | 1.25 | 0.00 | 0.00 |
| | 30 | 9.44 | 1.07 | 0.00 | 0.00 |
| | 10 | 12.49 | 0.14 | 0.00 | 0.00 |
| | 0.4 | 12.12 | 0.25 | 0.00 | 0.00 |
| G012280 | 90 | 4.32 | 0.20 | 0.44 | 0.02 |
| | 30 | 3.08 | 0.18 | 0.46 | 0.00 |
| | 10 | 7.70 | 0.21 | 0.13 | 0.02 |
| | 0.4 | 11.69 | 1.13 | 0.00 | 0.00 |
| G012293 | 90 | 0.80 | 0.22 | 0.80 | 0.03 |
| | 30 | 0.54 | 0.09 | 0.80 | 0.02 |
| | 10 | 2.56 | 0.16 | 0.59 | 0.00 |
| | 0.4 | 11.79 | 0.23 | 0.01 | 0.00 |
| G012294 | 90 | 6.96 | 0.48 | 0.39 | 0.09 |
| | 30 | 6.21 | 0.29 | 0.41 | 0.03 |
| | 10 | 15.19 | 1.13 | 0.12 | 0.00 |
| | 0.4 | 24.96 | 3.85 | 0.00 | 0.00 |
| G012298 | 90 | 18.40 | 0.36 | ND | ND |
| | 30 | 25.03 | 2.87 | ND | ND |

TABLE 11-continued

KLKB1 editing data and secreted KLKB1 protein levels in PCH

| guide | Guide concentration (nM) | Mean Indel Freq | SD | Mean secreted KLKB1 | SD |
|---|---|---|---|---|---|
| | 10 | 24.81 | 2.89 | ND | ND |
| | 0.4 | 23.59 | 3.91 | ND | ND |
| G012303 | 90 | 18.34 | 4.33 | 0.16 | 0.06 |
| | 30 | 16.05 | 4.43 | 0.17 | 0.00 |
| | 10 | 26.04 | 3.42 | 0.03 | 0.00 |
| | 0.4 | 27.82 | 2.74 | 0.00 | 0.00 |
| G012304 | 90 | 5.75 | 1.35 | 0.52 | 0.04 |
| | 30 | 6.14 | 0.68 | 0.54 | 0.01 |
| | 10 | 17.23 | 1.75 | 0.21 | 0.04 |
| | 0.4 | 24.90 | 0.95 | 0.00 | 0.00 |
| G012305 | 90 | 19.27 | 4.43 | 0.07 | 0.02 |
| | 30 | 18.57 | 3.56 | 0.11 | 0.01 |
| | 10 | 22.11 | 2.31 | 0.02 | 0.00 |
| | 0.4 | 27.30 | 1.17 | 0.00 | 0.00 |
| G012308 | 90 | 6.97 | 2.00 | 0.44 | 0.04 |
| | 30 | 7.52 | 0.00 | 0.49 | 0.03 |
| | 10 | 14.43 | 0.07 | 0.18 | 0.05 |
| | 0.4 | 22.80 | 2.56 | 0.00 | 0.00 |
| G012321 | 90 | 4.95 | 1.25 | ND | ND |
| | 30 | 5.96 | 0.07 | ND | ND |
| | 10 | 10.71 | 0.16 | ND | ND |
| | 0.4 | 23.83 | 1.78 | ND | ND |
| G012323 | 90 | 9.93 | 2.24 | ND | ND |
| | 30 | 8.97 | 3.13 | ND | ND |
| | 10 | 15.75 | 0.20 | ND | ND |
| | 0.4 | 22.16 | 0.27 | ND | ND |

Figure 5I:
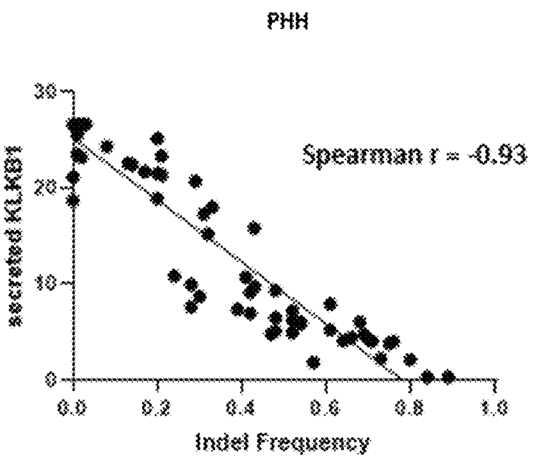
Figure 5J:
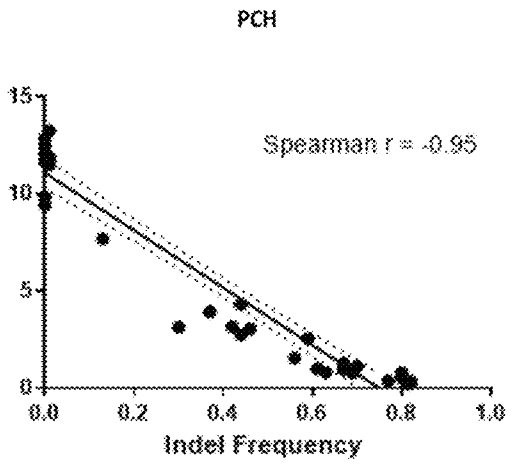

Indel frequency and secreted KLKB1 protein levels were shown to be inversely correlated in both PHH and PCH as shown in FIGS. 5I-5J.

3.2 Cross Screening of sgRNAs in PHH and PCH in 7-Point Dose Response Assays

Lipid nanoparticle (LNP) formulations of sgRNAs targeting human KLKB1 sgRNA sequences were tested in PHH and PCH in a dose response assay.

The LNPs were formulated as described in Example 1. The final LNPs were characterized to determine the encapsulation efficiency, polydispersity index, and average particle size according to the analytical methods provided above.

Primary human and cynomolgus hepatocytes were plated as described in Example 1. Both cell lines were incubated at 37° C., with 5% CO2 for 24 hours prior to treatment with LNPs. LNPs were incubated in media containing 3% FBS at 37° C. for 10 minutes. Post incubation, the LNPs were added to the human or cynomolgus hepatocytes in a 7 point 3-fold dose response curve. The cells were lysed 72 hours post-transfection and gDNAs were subjected to quantified PCR for NGS analysis as described in Example 1.

Figure 6A:
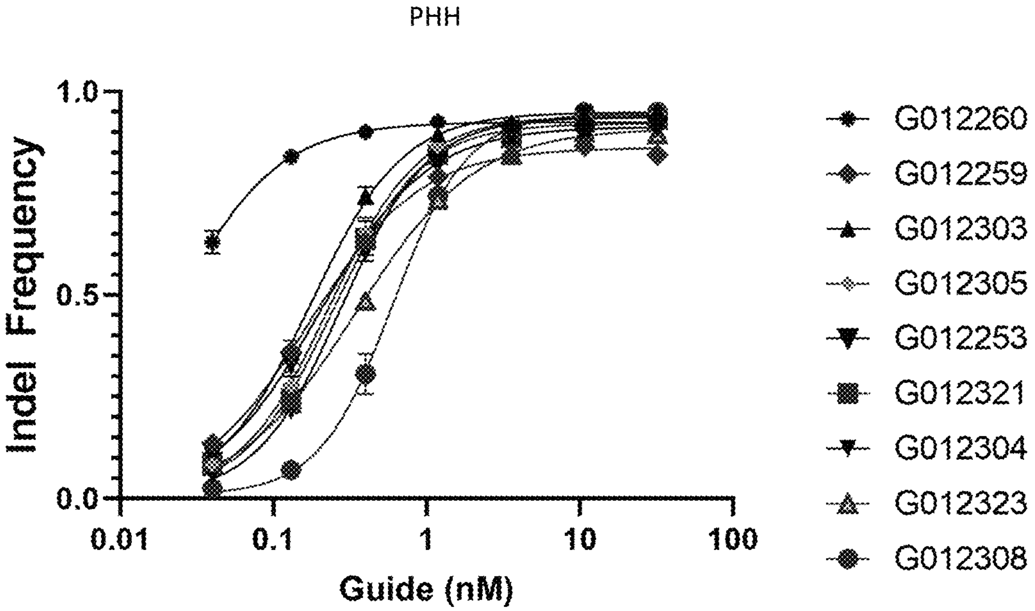
FIGS. 6A-6D provide dose response curve data for indel frequency for certain guide sequences in PHH (FIGS. 6A-6B) and PCH (FIGS. 6C-6D).
Figure 6B:
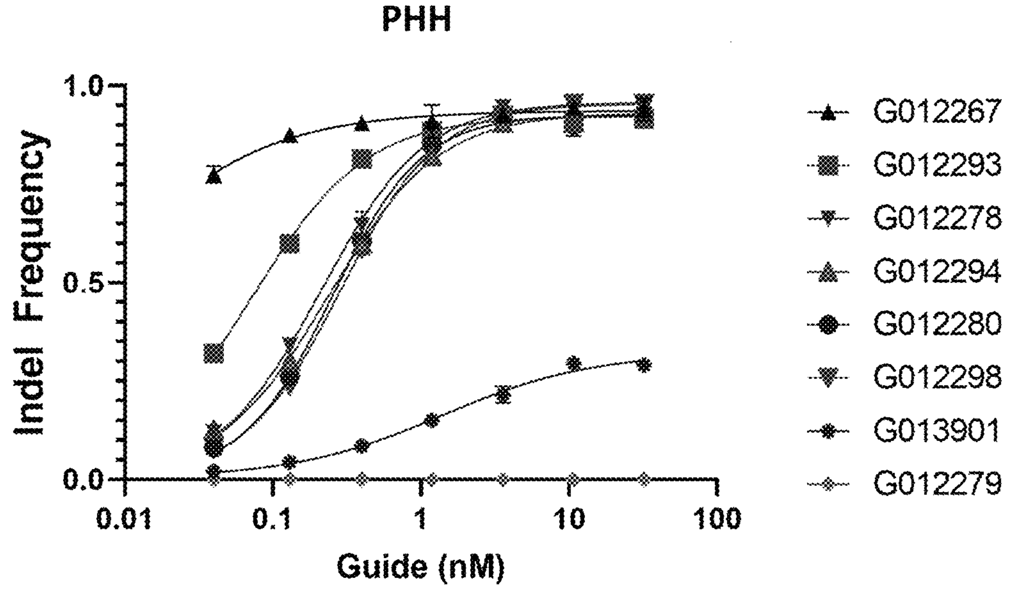
Figure 6C:
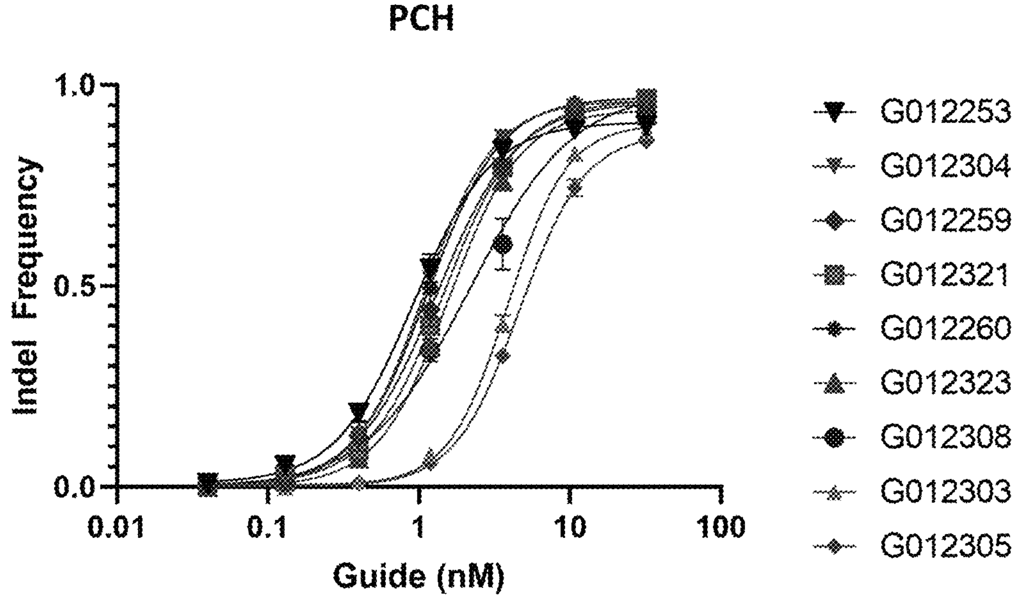
Figure 6D:
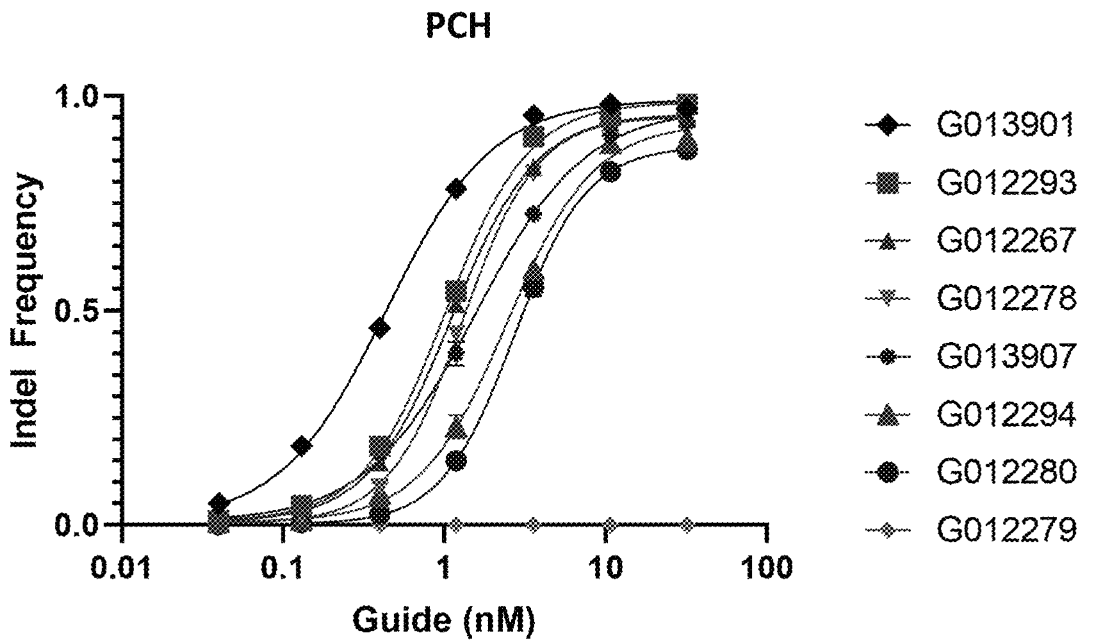

The indel frequency of sgRNAs at concentrations of 0.04 nM, 0.13 nM, 0.40 nM, 1.19 nM, 3.58 nM, 10.75 nM, and 32.25 nM are shown in Table 12 and corresponding dose response curves are shown in FIGS. 6A-B for PHH and FIGS. 6C-D for PCH.

TABLE 12

| Indel frequency and secreted KLKB1 protein for LNPs targeting KLKB1 in vitro | | | | | | | | | |
|---|---|---|---|---|---|---|---|---|---|
| | | PHH | | | | PCH | | | |
| GUIDE ID | Guide conc. (nM) | Mean Indel Freq | SD | Mean Secreted KLKB1 | SD | Mean Indel Freq | SD | Mean Secreted KLKB1 | SD |
| G012253 | 32.25 | 0.91 | 0.00 | −1.38 | 0.22 | 0.90 | 0.01 | −1.58 | 0.10 |
| | 10.75 | 0.89 | 0.00 | −1.30 | 0.08 | 0.89 | 0.01 | −1.57 | 0.07 |
| | 3.58 | 0.89 | 0.02 | −1.23 | 0.19 | 0.84 | 0.00 | −1.39 | 0.07 |
| | 1.19 | 0.83 | 0.01 | −0.48 | 0.11 | 0.55 | 0.03 | 5.01 | 0.24 |
| | 0.40 | 0.64 | 0.04 | 2.49 | 0.07 | 0.18 | 0.02 | 22.35 | 0.29 |
| | 0.13 | 0.34 | 0.03 | 9.34 | 0.01 | 0.05 | 0.01 | 27.18 | 0.07 |
| | 0.04 | 0.12 | 0.01 | 15.04 | 0.17 | 0.01 | 0.00 | 27.18 | 0.07 |
| G012259 | 32.25 | 0.84 | 0.01 | −1.12 | 0.21 | 0.95 | 0.01 | −1.57 | 0.07 |
| | 10.75 | 0.86 | 0.01 | −1.17 | 0.11 | 0.93 | 0.01 | −1.57 | 0.02 |
| | 3.58 | 0.85 | 0.02 | −1.00 | 0.06 | 0.80 | 0.00 | −0.71 | 0.70 |
| | 1.19 | 0.79 | 0.01 | −0.28 | 0.04 | 0.44 | 0.04 | 8.93 | 0.23 |
| | 0.40 | 0.63 | 0.02 | 2.37 | 0.19 | 0.12 | 0.03 | 25.94 | 0.05 |
| | 0.13 | 0.36 | 0.03 | 8.32 | 0.31 | 0.01 | 0.00 | 27.18 | 0.07 |
| | 0.04 | 0.13 | 0.01 | 12.97 | 0.41 | 0.00 | 0.00 | 27.18 | 0.07 |
| G012260 | 32.25 | 0.93 | 0.00 | −1.36 | 0.21 | 0.96 | 0.00 | −1.32 | 0.18 |
| | 10.75 | 0.92 | 0.01 | −1.35 | 0.15 | 0.95 | 0.01 | −1.41 | 0.37 |
| | 3.58 | 0.92 | 0.01 | −1.43 | 0.19 | 0.87 | 0.02 | −0.94 | 0.03 |
| | 1.19 | 0.92 | 0.01 | −1.37 | 0.27 | 0.50 | 0.00 | 7.33 | 0.02 |
| | 0.40 | 0.90 | 0.00 | −1.03 | 0.17 | 0.13 | 0.01 | 24.00 | 1.03 |
| | 0.13 | 0.84 | 0.02 | 0.30 | 0.03 | 0.03 | 0.00 | 27.18 | 0.07 |
| | 0.04 | 0.63 | 0.03 | 4.51 | 0.20 | 0.00 | 0.00 | 26.95 | 0.39 |
| G012267 | 32.25 | 0.94 | 0.03 | −1.58 | 0.13 | 0.95 | 0.02 | −1.88 | 0.02 |
| | 10.75 | 0.94 | 0.01 | −1.50 | 0.08 | 0.94 | 0.02 | −1.94 | 0.02 |
| | 3.58 | 0.93 | 0.01 | −1.57 | 0.13 | 0.84 | 0.00 | −1.48 | 0.10 |
| | 1.19 | 0.91 | 0.05 | −1.62 | 0.25 | 0.52 | 0.01 | 7.68 | 0.29 |
| | 0.40 | 0.91 | 0.01 | −1.48 | 0.22 | 0.15 | 0.01 | 24.74 | 1.33 |
| | 0.13 | 0.87 | 0.01 | −0.77 | 0.07 | 0.04 | 0.01 | 27.00 | 0.05 |
| | 0.04 | 0.78 | 0.02 | 1.28 | 0.07 | 0.01 | 0.00 | 27.00 | 0.05 |
| G012278 | 32.25 | 0.95 | 0.00 | −1.63 | 0.18 | 0.95 | 0.01 | −1.87 | 0.04 |
| | 10.75 | 0.94 | 0.01 | −1.64 | 0.10 | 0.94 | 0.01 | −1.91 | 0.14 |
| | 3.58 | 0.94 | 0.00 | −1.59 | 0.05 | 0.82 | 0.02 | −1.41 | 0.16 |
| | 1.19 | 0.88 | 0.01 | −1.38 | 0.20 | 0.44 | 0.01 | 8.23 | 0.17 |
| | 0.40 | 0.65 | 0.03 | 0.29 | 0.14 | 0.08 | 0.03 | 26.13 | 1.19 |
| | 0.13 | 0.34 | 0.02 | 5.68 | 0.20 | 0.02 | 0.00 | 27.00 | 0.05 |
| | 0.04 | 0.12 | 0.01 | 12.54 | 0.43 | 0.01 | 0.00 | 27.00 | 0.05 |
| G012279 | 32.25 | 0.00 | 0.00 | −0.99 | 0.39 | 0.00 | 0.00 | 0.02 | 0.11 |
| | 10.75 | 0.00 | 0.00 | −0.56 | 0.05 | 0.00 | 0.00 | 8.49 | 0.34 |
| | 3.58 | 0.00 | 0.00 | 3.54 | 0.08 | 0.00 | 0.00 | 26.50 | 0.03 |
| | 1.19 | 0.00 | 0.00 | 12.69 | 0.56 | 0.00 | 0.00 | 27.00 | 0.05 |
| | 0.40 | 0.00 | 0.00 | 15.91 | 0.26 | 0.00 | 0.00 | 26.85 | 0.17 |
| | 0.13 | 0.00 | 0.00 | 17.60 | 0.18 | 0.00 | 0.00 | 27.00 | 0.05 |
| | 0.04 | 0.00 | 0.00 | 17.32 | 0.00 | 0.00 | 0.00 | 27.00 | 0.05 |
| G012280 | 32.25 | 0.93 | 0.01 | −1.68 | 0.27 | 0.87 | 0.01 | −1.91 | 0.01 |
| | 10.75 | 0.90 | 0.03 | −1.56 | 0.20 | 0.83 | 0.01 | −1.62 | 0.30 |
| | 3.58 | 0.91 | 0.03 | −1.55 | 0.11 | 0.56 | 0.02 | 2.88 | 0.53 |
| | 1.19 | 0.85 | 0.01 | −0.61 | 0.27 | 0.15 | 0.00 | 21.86 | 0.24 |
| | 0.40 | 0.61 | 0.02 | 4.05 | 0.45 | 0.02 | 0.00 | 26.36 | 0.86 |
| | 0.13 | 0.26 | 0.01 | 11.55 | 0.19 | 0.01 | 0.00 | 27.00 | 0.05 |
| | 0.04 | 0.08 | 0.00 | 15.47 | 0.38 | 0.00 | 0.00 | 27.00 | 0.05 |
| G012293 | 32.25 | 0.91 | 0.00 | −1.79 | 0.18 | 0.98 | 0.00 | 1.82 | 0.06 |
| | 10.75 | 0.91 | 0.01 | −1.63 | 0.19 | 0.96 | 0.02 | −1.84 | 0.02 |
| | 3.58 | 0.92 | 0.02 | −1.65 | 0.27 | 0.90 | 0.00 | −1.21 | 0.55 |
| | 1.19 | 0.89 | 0.00 | −1.27 | 0.55 | 0.54 | 0.02 | 3.40 | 0.13 |
| | 0.40 | 0.82 | 0.02 | −0.36 | 0.32 | 0.19 | 0.02 | 22.12 | 0.61 |
| | 0.13 | 0.60 | 0.00 | 3.31 | 0.19 | 0.04 | 0.02 | 26.91 | 0.09 |
| | 0.04 | 0.32 | 0.01 | 10.09 | 0.50 | 0.01 | 0.00 | 27.00 | 0.04 |
| G012294 | 32.25 | 0.93 | 0.01 | −1.58 | 0.28 | 0.90 | 0.02 | −1.84 | 0.12 |
| | 10.75 | 0.91 | 0.01 | −1.41 | 0.14 | 0.89 | 0.00 | −1.86 | 0.04 |
| | 3.58 | 0.91 | 0.01 | 1.46 | 0.23 | 0.60 | 0.00 | −0.15 | 0.19 |
| | 1.19 | 0.82 | 0.02 | −0.96 | 0.32 | 0.23 | 0.03 | 13.68 | 0.43 |
| | 0.40 | 0.60 | 0.03 | 1.61 | 0.43 | 0.07 | 0.03 | 25.94 | 1.04 |
| | 0.13 | 0.30 | 0.01 | 7.91 | 0.02 | 0.01 | 0.00 | 26.73 | 0.16 |
| | 0.04 | 0.12 | 0.00 | 12.18 | 1.01 | 0.01 | 0.00 | 27.00 | 0.05 |
| G012298 | 32.25 | 0.95 | 0.00 | −0.50 | 0.11 | NA | NA | 15.77 | 0.15 |
| | 10.75 | 0.95 | 0.00 | −0.47 | 0.23 | NA | NA | 27.00 | 0.05 |
| | 3.58 | 0.91 | 0.00 | −0.15 | 0.21 | NA | NA | 27.00 | 0.05 |
| | 1.19 | 0.83 | 0.01 | 0.88 | 0.40 | NA | NA | 27.00 | 0.05 |
| | 0.40 | 0.59 | 0.01 | 6.54 | 0.52 | NA | NA | 26.39 | 0.82 |
| | 0.13 | 0.24 | 0.02 | 12.35 | 0.21 | NA | NA | 27.00 | 0.05 |
| | 0.04 | 0.08 | 0.00 | 16.29 | 1.12 | NA | NA | 27.00 | 0.05 |

TABLE 12-continued

Indel frequency and secreted KLKB1 protein for LNPs targeting KLKB1 in vitro

| | | PHH | | | | PCH | | | |
|---|---|---|---|---|---|---|---|---|---|
| GUIDE ID | Guide conc. (nM) | Mean Indel Freq | SD | Mean Secreted KLKB1 | SD | Mean Indel Freq | SD | Mean Secreted KLKB1 | SD |
| G012303 | 32.25 | 0.96 | 0.01 | −1.27 | 0.14 | 0.88 | 0.01 | −1.55 | 0.10 |
| | 10.75 | 0.94 | 0.00 | −1.39 | 0.18 | 0.83 | 0.02 | −1.36 | 0.12 |
| | 3.58 | 0.93 | 0.01 | −1.28 | 0.15 | 0.40 | 0.02 | 8.20 | 0.71 |
| | 1.19 | 0.90 | 0.01 | −0.60 | 0.18 | 0.08 | 0.01 | 26.23 | 0.95 |
| | 0.40 | 0.74 | 0.02 | 2.18 | 0.05 | 0.02 | 0.00 | 27.18 | 0.07 |
| | 0.13 | 0.36 | 0.01 | 9.45 | 0.14 | 0.00 | 0.00 | 27.18 | 0.07 |
| | 0.04 | 0.13 | 0.01 | 15.14 | 0.26 | 0.00 | 0.00 | 27.18 | 0.07 |
| G012304 | 32.25 | 0.94 | 0.01 | −1.37 | 0.32 | 0.96 | 0.00 | −1.70 | 0.19 |
| | 10.75 | 0.95 | 0.01 | −1.39 | 0.10 | 0.94 | 0.01 | −1.72 | 0.08 |
| | 3.58 | 0.91 | 0.00 | −1.41 | 0.21 | 0.87 | 0.00 | −1.52 | 0.01 |
| | 1.19 | 0.84 | 0.02 | −0.38 | 0.15 | 0.52 | 0.02 | 6.62 | 0.71 |
| | 0.40 | 0.61 | 0.02 | 3.74 | 0.19 | 0.13 | 0.02 | 25.35 | 1.70 |
| | 0.13 | 0.22 | 0.01 | 11.39 | 0.18 | 0.02 | 0.00 | 27.18 | 0.07 |
| | 0.04 | 0.06 | 0.00 | 15.41 | 0.72 | 0.00 | 0.00 | 27.18 | 0.07 |
| G012305 | 32.25 | 0.95 | 0.01 | −1.26 | 0.16 | 0.86 | 0.01 | −1.53 | 0.11 |
| | 10.75 | 0.94 | 0.00 | −1.37 | 0.13 | 0.75 | 0.02 | −0.43 | 0.12 |
| | 3.58 | 0.92 | 0.02 | −1.30 | 0.15 | 0.33 | 0.01 | 15.42 | 0.72 |
| | 1.19 | 0.86 | 0.01 | −0.26 | 0.07 | 0.06 | 0.00 | 27.18 | 0.07 |
| | 0.40 | 0.65 | 0.03 | 3.85 | 0.04 | 0.01 | 0.00 | 27.18 | 0.07 |
| | 0.13 | 0.27 | 0.04 | 10.94 | 0.24 | 0.00 | 0.00 | 27.18 | 0.07 |
| | 0.04 | 0.08 | 0.01 | 15.12 | 0.54 | 0.00 | 0.00 | 27.18 | 0.07 |
| G012308 | 32.25 | 0.95 | 0.01 | −1.07 | 0.19 | 0.93 | 0.02 | −1.66 | 0.12 |
| | 10.75 | 0.95 | 0.01 | −0.92 | 0.07 | 0.92 | 0.01 | −1.44 | 0.02 |
| | 3.58 | 0.88 | 0.02 | −0.77 | 0.27 | 0.60 | 0.07 | −0.18 | 0.32 |
| | 1.19 | 0.75 | 0.01 | 1.00 | 0.10 | 0.34 | 0.03 | 14.44 | 0.04 |
| | 0.40 | 0.31 | 0.05 | 7.89 | 0.27 | 0.08 | 0.02 | 26.77 | 0.64 |
| | 0.13 | 0.07 | 0.00 | 12.76 | 0.59 | 0.03 | 0.02 | 27.18 | 0.07 |
| | 0.04 | 0.02 | 0.01 | 14.75 | 0.43 | 0.00 | 0.00 | 27.17 | 0.05 |
| G012321 | 32.25 | 0.93 | 0.00 | −1.17 | 0.24 | 0.96 | 0.01 | −1.68 | 0.19 |
| | 10.75 | 0.93 | 0.01 | −1.26 | 0.14 | 0.92 | 0.02 | −1.60 | 0.12 |
| | 3.58 | 0.88 | 0.02 | −1.07 | 0.21 | 0.80 | 0.02 | −0.84 | 0.10 |
| | 1.19 | 0.85 | 0.00 | −0.17 | 0.17 | 0.40 | 0.02 | 14.33 | 0.57 |
| | 0.40 | 0.63 | 0.02 | 3.56 | 0.06 | 0.09 | 0.01 | 23.98 | 1.24 |
| | 0.13 | 0.25 | 0.03 | 10.27 | 0.82 | 0.03 | 0.02 | 27.17 | 0.05 |
| | 0.04 | 0.09 | 0.01 | 13.27 | 0.79 | 0.01 | 0.00 | 27.18 | 0.07 |
| G012323 | 32.25 | 0.89 | 0.01 | −1.17 | 0.28 | 0.93 | 0.00 | −1.74 | 0.12 |
| | 10.75 | 0.90 | 0.00 | −1.35 | 0.14 | 0.93 | 0.00 | −1.72 | 0.03 |
| | 3.58 | 0.84 | 0.01 | −1.14 | 0.17 | 0.76 | 0.54 | −0.36 | 0.32 |
| | 1.19 | 0.73 | 0.01 | 0.20 | 0.14 | 0.35 | 0.01 | 15.43 | 0.17 |
| | 0.40 | 0.49 | 0.01 | 4.28 | 0.04 | 0.07 | 0.01 | 25.63 | 1.00 |
| | 0.13 | 0.23 | 0.02 | 10.12 | 1.03 | 0.01 | 0.00 | 27.18 | 0.07 |
| | 0.04 | 0.08 | 0.01 | 14.08 | 0.80 | 0.00 | 0.00 | 27.18 | 0.07 |
| G013901 | 32.25 | 0.29 | 0.01 | 7.11 | 0.34 | 0.97 | 0.00 | −1.58 | 0.48 |
| | 10.75 | 0.29 | 0.00 | 8.89 | 0.40 | 0.98 | 0.00 | −1.76 | 0.26 |
| | 3.58 | 0.22 | 0.02 | 10.94 | 0.34 | 0.95 | 0.01 | −1.81 | 0.19 |
| | 1.19 | 0.15 | 0.02 | 14.44 | 0.70 | 0.79 | 0.01 | −0.82 | 0.32 |
| | 0.40 | 0.08 | 0.01 | 13.76 | 0.22 | 0.46 | 0.00 | 8.67 | 0.27 |
| | 0.13 | 0.05 | 0.00 | 14.80 | 0.40 | 0.19 | 0.01 | 21.35 | 0.16 |
| | 0.04 | 0.02 | 0.00 | 14.97 | 0.59 | 0.05 | 0.00 | 26.84 | 0.19 |
| untreated | NA | 0.00 | 0.00 | 13.62 | 0.95 | 0.00 | 0.00 | 25.77 | 2.09 |

3.3 Cross Screening of Lead sgRNAs in PCH and PHH in 7-Point Dose Response Assays Lipid nanoparticle (LNP) formulations of modified sgRNAs were tested in PHH and PCH in a dose response assay.

The LNPs described in Example 3.2 were used in this study.

Post incubation, the LNPs were added to the human or cynomolgus hepatocytes in a 7 point, 3-fold dose response curve. The cells were lysed 72 hours post-transfection and gDNAs were subjected to quantified PCR for NGS analysis as described in Example 1. For KLKB1 protein analysis the cells were lysed at day 8 post-transfection and whole cell extracts were subject to western blotting analysis as described in Example 1.

Figure 7A:
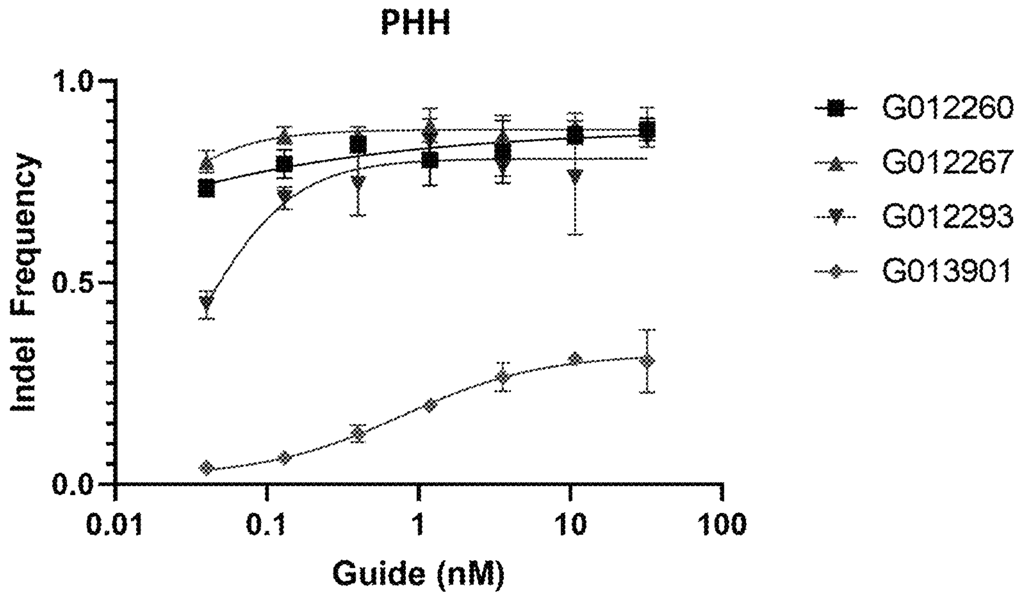
FIGS. 7A-7E show dose response curve data for indel frequency (FIGS. 7A and 7B) and KLKB1 secretion (FIGS. 7C and 7D) for certain guide sequences in PHH (FIGS. 7A and 7C) and PCH (FIGS. 7B and 7D) and western blot analysis to measure secreted protein (FIG. 7E).
Figure 7B:
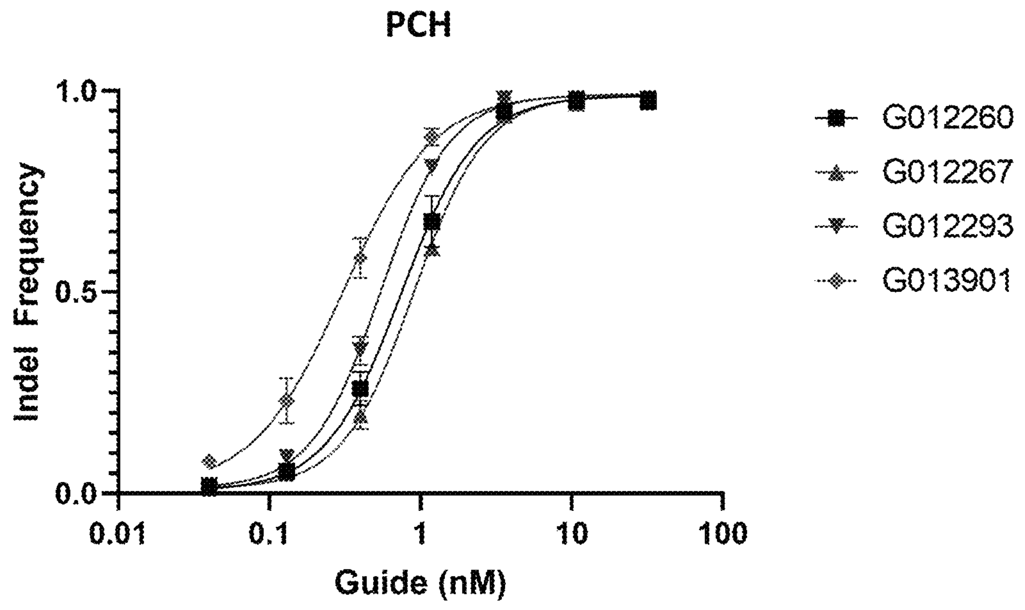
Figure 7C:
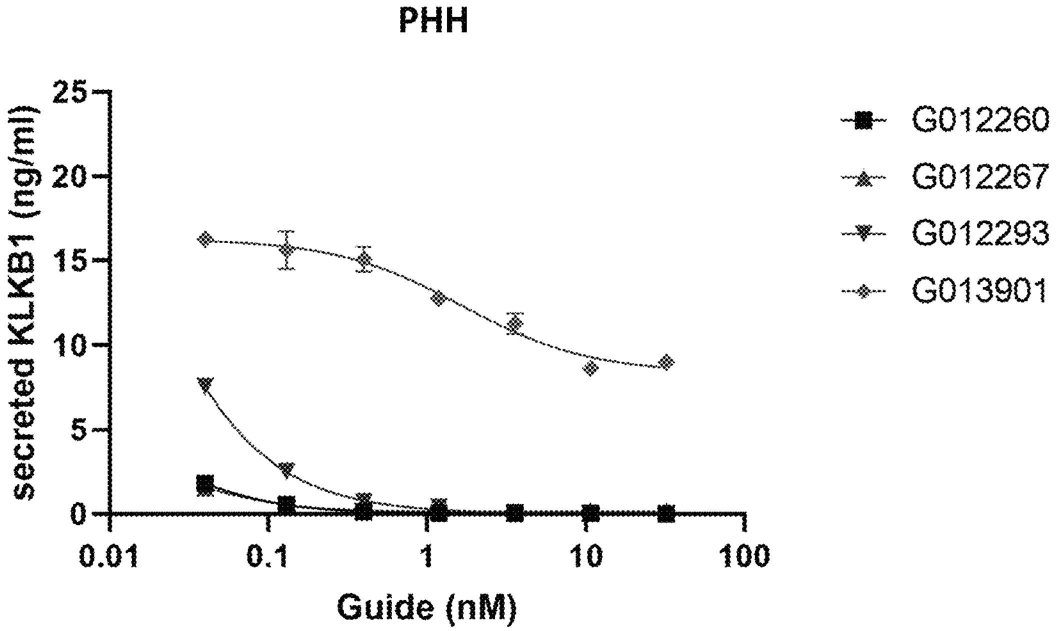
Figure 7D:
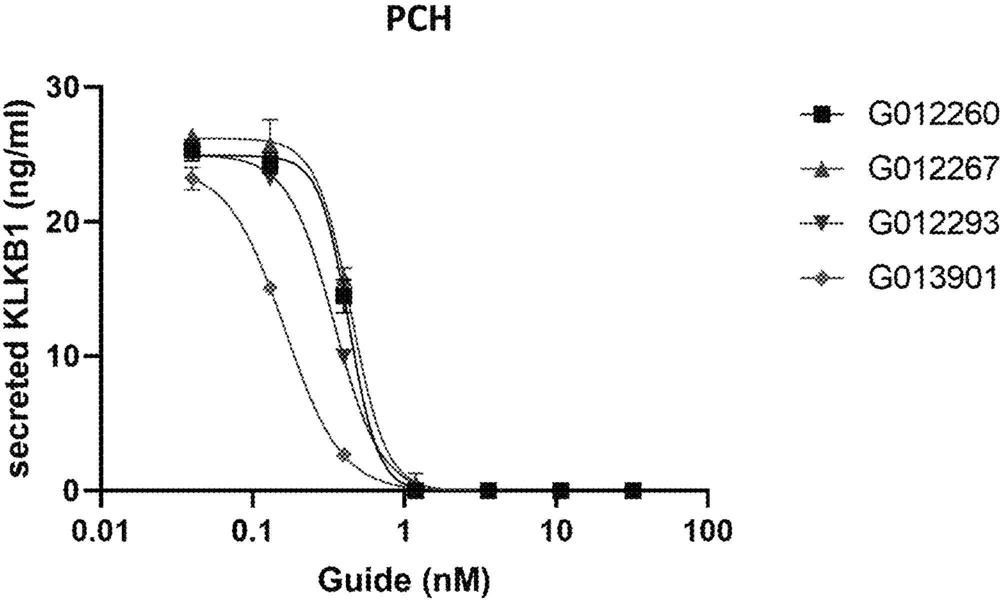

The indel frequency of sgRNAs at concentrations of 0.04 nM, 0.13 nM, 0.40 nM, 1.19 nM, 3.58 nM, 10.75 nM, and 32.25 nM for PHH and PCH is shown in Table 13 and dose response curve data is illustrated in FIGS. 7A and 7B. Secreted KLKB1 protein levels of the sgRNAs determined by ELISA is shown in Table 13 and FIG. 7C for PHH and in FIG. 7D for PCH.

TABLE 13

Indel frequency and secreted KLKB1 protein for LNPs targeting KLKB1 in vitro

| | PHH | | | | | PCH | | | | |
|---|---|---|---|---|---|---|---|---|---|---|
| GUIDE ID | Guide conc. (nM) | Mean Indel Freq | SD | Mean secreted KLKB1 | SD | Guide conc. (nM) | Mean Indel Freq | SD | Mean secreted KLKB1 | SD |
| G012260 | 32.25 | 0.88 | 0.03 | −0.07 | 0.04 | 32.25 | 0.97 | 0.01 | −1.42 | 0.04 |
| | 10.75 | 0.86 | 0.03 | 0.05 | 0.09 | 10.75 | 0.98 | 0.01 | −1.32 | 0.03 |
| | 3.58 | 0.82 | 0.08 | 0.03 | 0.04 | 3.58 | 0.95 | 0.00 | −1.41 | 0.04 |
| | 1.19 | 0.81 | 0.07 | 0.06 | 0.00 | 1.19 | 0.68 | 0.07 | −0.08 | 0.03 |
| | 0.40 | 0.84 | 0.00 | 0.14 | 0.00 | 0.40 | 0.26 | 0.04 | 14.46 | 1.24 |
| | 0.13 | 0.79 | 0.04 | 0.55 | 0.01 | 0.13 | 0.06 | 0.01 | 24.37 | 0.74 |
| | 0.04 | 0.73 | 0.02 | 1.80 | 0.01 | 0.04 | 0.01 | 0.00 | 25.32 | 0.79 |
| G012267 | 32.25 | 0.88 | 0.05 | 0.11 | 0.02 | 32.25 | 0.98 | 0.00 | −1.46 | 0.01 |
| | 10.75 | 0.89 | 0.04 | 0.17 | 0.01 | 10.75 | 0.97 | 0.02 | −1.28 | 0.14 |
| | 3.58 | 0.87 | 0.05 | 0.16 | 0.05 | 3.58 | 0.94 | 0.00 | −1.36 | 0.08 |
| | 1.19 | 0.89 | 0.04 | 0.12 | 0.02 | 1.19 | 0.61 | 0.01 | 1.06 | 0.00 |
| | 0.40 | 0.86 | 0.02 | 0.23 | 0.02 | 0.40 | 0.20 | 0.03 | 15.86 | 0.74 |
| | 0.13 | 0.87 | 0.02 | 0.54 | 0.00 | 0.13 | 0.05 | 0.00 | 25.73 | 1.85 |
| | 0.04 | 0.80 | 0.03 | 1.54 | 0.06 | 0.04 | 0.02 | 0.00 | 26.39 | 0.16 |
| G012293 | 32.25 | 0.85 | 0.00 | −0.09 | 0.07 | 32.25 | 0.98 | 0.01 | −1.43 | 0.02 |
| | 10.75 | 0.76 | 0.15 | −0.04 | 0.01 | 10.75 | 0.98 | 0.01 | −1.32 | 0.06 |
| | 3.58 | 0.78 | 0.02 | 0.06 | 0.08 | 3.58 | 0.98 | 0.00 | −1.37 | 0.07 |
| | 1.19 | 0.85 | 0.06 | 0.39 | 0.30 | 1.19 | 0.81 | 0.01 | −0.89 | 0.04 |
| | 0.40 | 0.74 | 0.08 | 0.71 | 0.01 | 0.40 | 0.35 | 0.03 | 9.93 | 0.49 |
| | 0.13 | 0.71 | 0.02 | 2.52 | 0.12 | 0.13 | 0.09 | 0.00 | 23.26 | 0.06 |
| | 0.04 | 0.45 | 0.03 | 7.55 | 0.09 | 0.04 | 0.02 | 0.00 | 25.17 | 0.05 |
| G013901 | 32.25 | 0.31 | 0.07 | 9.02 | 0.05 | 32.25 | 0.98 | 0.00 | −1.47 | 0.02 |
| | 10.75 | 0.31 | 0.02 | 8.64 | 0.30 | 10.75 | 0.98 | 0.00 | −1.35 | 0.04 |
| | 3.58 | 0.26 | 0.03 | 11.28 | 0.62 | 3.58 | 0.98 | 0.00 | −1.45 | 0.03 |
| | 1.19 | 0.19 | 0.01 | 12.75 | 0.42 | 1.19 | 0.89 | 0.02 | −1.32 | 0.09 |
| | 0.40 | 0.13 | 0.02 | 15.06 | 0.73 | 0.40 | 0.58 | 0.05 | 2.65 | 0.28 |
| | 0.13 | 0.06 | 0.01 | 15.61 | 1.11 | 0.13 | 0.23 | 0.05 | 15.10 | 0.22 |
| | 0.04 | 0.04 | 0.00 | 16.27 | 0.46 | 0.04 | 0.08 | 0.00 | 23.21 | 0.82 |
| untreated | NA | 0.00 | 0.00 | 18.29 | 1.14 | NA | 0.00 | 0.00 | 25.96 | 1.35 |

Figure 7E:
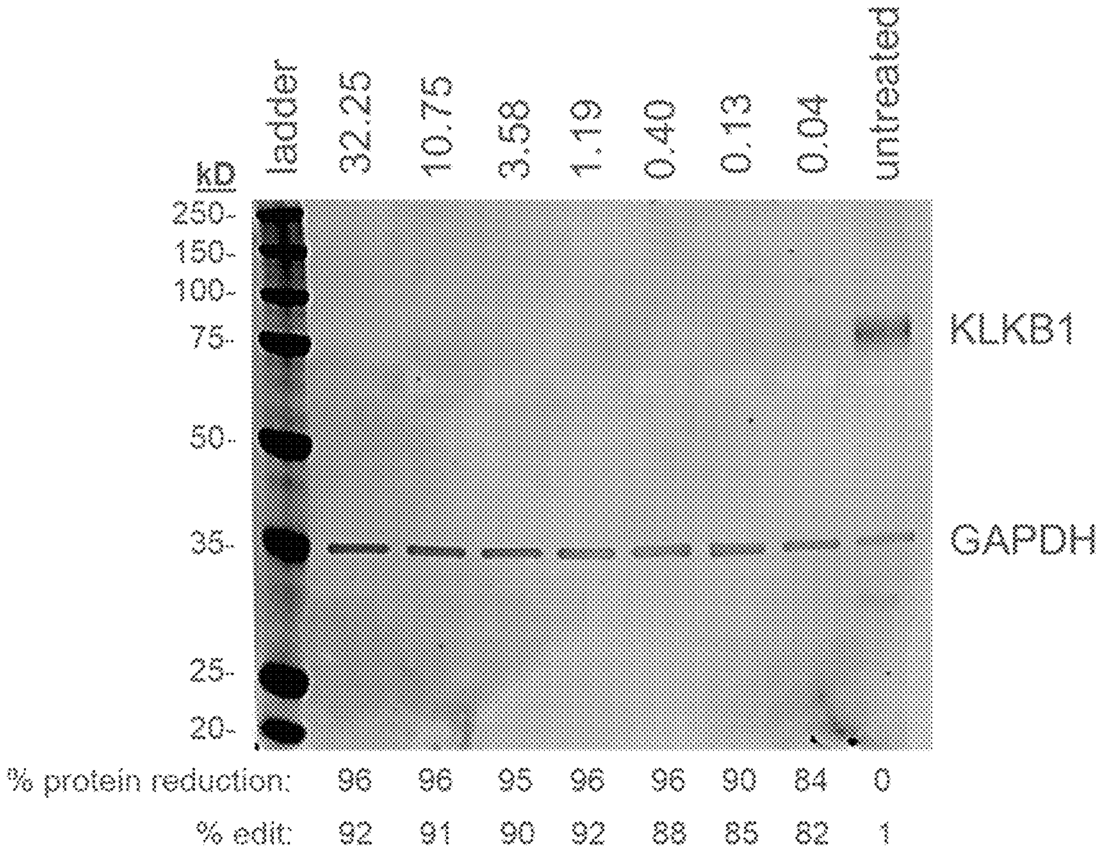

For KLKB1 protein analysis, PHH were transfected with human KLKB1 guide, G012267, and lysed at day 8 post-transfection and whole cell extracts were subject to western blotting analysis as described in Example 1. Human KLKB1 protein levels across the 7-point dose response curve were compared to untreated control and normalized to GAPDH is shown in FIG. 7E.

Example 4—Off-Target Analysis of KLKB1 Guides

The biochemical method described in Example 1 was used to determine potential off-target genomic sites cleaved by Cas9 targeting KLKB1. Guides selected based on results from experiments described above were tested for potential off-target genomic cleavage sites. Sixteen KLKB1 targeting guides were evaluated for off-target genomic cleavage against genomic DNA from HEK293 cells at a 16 nM concentration (ATCC, Cat. #CRL-1573). KLKB1 guide G012267 and control guides with known off-target profiles were included in experiments (G000644 targeted to EMX1 for which 281 off-target sites have been detected, G00045 targeted to VEGFA for which 6602 off-target sites have been detected); Frock et al., 2015, Tsai et al., 2015) were evaluated for off-target genomic cleavage against genomic DNA from pooled human PBMC at a 64 nM concentration. The number of potential off-target sites detected in the biochemical assay using genomic DNA from HEK 293 cells are shown in Table 14A. The number of potential off-target sites detected in the biochemical assay using genomic DNA from PBMCs are shown in Table 14B. The percent of off-target sites detected by the assay performed herein as compared to the number of off-target sites noted in the literature for the EMX1 guide and the VEGFA guide are noted.

TABLE 14A

Biochemical Off-Target Analysis with HEK293 cell genomic DNA

| Guide ID | Target | Guide Concentration (nM) | Off-target sites |
|---|---|---|---|
| G012253 | KLKB1 | 16 | 122 |
| G012259 | KLKB1 | 16 | 77 |
| G012260 | KLKB1 | 16 | 153 |
| G012267 | KLKB1 | 16 | 136 |
| G012278 | KLKB1 | 16 | 153 |
| G012279 | KLKB1 | 16 | 0 |
| G012280 | KLKB1 | 16 | 292 |
| G012293 | KLKB1 | 16 | 126 |
| G012294 | KLKB1 | 16 | 132 |
| G012298 | KLKB1 | 16 | 155 |
| G012303 | KLKB1 | 16 | 45 |
| G012304 | KLKB1 | 16 | 42 |
| G012305 | KLKB1 | 16 | 48 |
| G012308 | KLKB1 | 16 | 116 |
| G012321 | KLKB1 | 16 | 107 |
| G012323 | KLKB1 | 16 | 14 |

TABLE 14B

Biochemical Off-Target Analysis with human PBMC genomic DNA

| Guide | Target | Off-Target sites (percent*) |
|---|---|---|
| G012267 | KLKB1 | 61 |
| G000644 | EMX1 | 242/281 (86%) |
| G000645 | VEGFA | 4431/6602 (67%) |

*Percent is relative to the known number of off-target sites for each of the guide target sites.

Example 5. Targeted Sequencing for Validating Potential Off-Target Sites

KLKB1 guides were selected based on experiments above for further evaluation. The targeted off-target approach described in Example 1 was used to evaluate the target indel activity for the potential off-targets associated with these guides. The off-target sites tested in the experiment were identified via the biochemical assay experiments described in Example 4 or in silico prediction as described in Example 1.

In this experiment, 3 sgRNAs targeting human KLKB1 were evaluated. PHH were cultured and transfected with LNPs comprising Cas9 mRNA and sgRNA of interest (e.g., an sgRNA having potential off-target sites for evaluation) as described in Example 1. Genomic DNA was isolated from the PHH and subjected to NGS and targeted off-target analysis as described in Example 1.

The number of potential off-target sites evaluated in the assay and of those sites, off-targets that were successfully characterized by the assay followed by sites that were validated via manual inspection are shown in Table 15A.

TABLE 15

Targeted Off-Target Analysis

| Guide ID | Off-targets evaluated | Off-targets characterized | Validated off-targets |
|---|---|---|---|
| G012260 | 223 | 206 | 5 |
| G012267 | 181 | 171 | 1 |
| G012293 | 360 | 347 | 4 |

Example 6. In Vivo Editing of the Humanized KLKB1 Locus in Hu KLKB1 Mouse Model

Humanized mice that express human KLKB1 protein (Hu KLKB1 mouse model) were used in this study. The Hu KLKB1 mouse model comprises a humanized KLKB1 locus in which the region from start codon to stop codon of mouse KLKB1 was replaced with the corresponding human genomic sequence. Animals were weighed and dosed at volumes specific to individual body weight. There were 5 groups total (N=4 with 2 male and 2 female mice).

LNPs containing modified sgRNAs (G12260, G12267, G12293, G12303, and G12321) and the Cas9 mRNA were dosed via the lateral tail vein at 0.3 mg/kg based on total RNA cargo in a volume of 10 ml per kilogram body weight. The final LNPs were characterized to determine the encapsulation efficiency, polydispersity index, and average particle size according to the analytical methods described in Example 1. At day 11 post-LNP administration, mice were euthanized, and liver tissue was collected for DNA extraction. The tissues were lysed using a Zymo Research Bashing Bead Lysis Rack, and DNA was extracted using the Zymo Research DNA Extraction Kit according to the manufacturer's protocol. The extracted DNA was subject to PCR to be submitted for sequencing.

Blood was collected into serum separator tubes and allowed to clot for 2 hours at room temperature followed by centrifugation. ELISA was performed on the serum aliquoted and diluted in a 96-well plate.

Figure 8A:
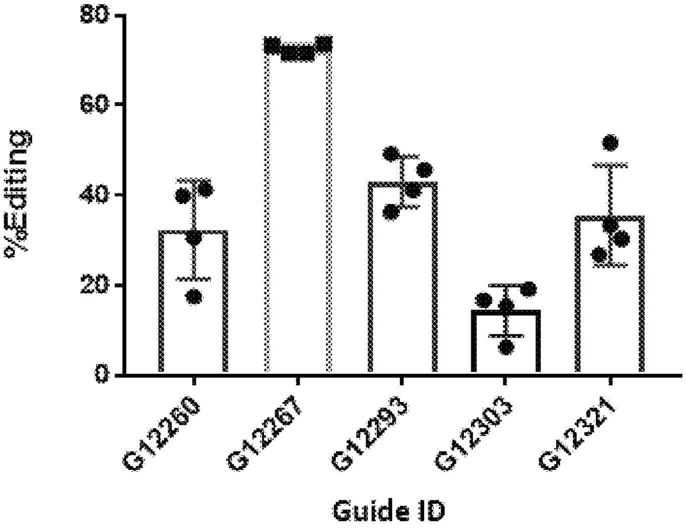
FIG. 8A shows KLKB1 editing % for various modified sgRNAs in vivo in Hu KLKB1 mice.
Figure 8B:
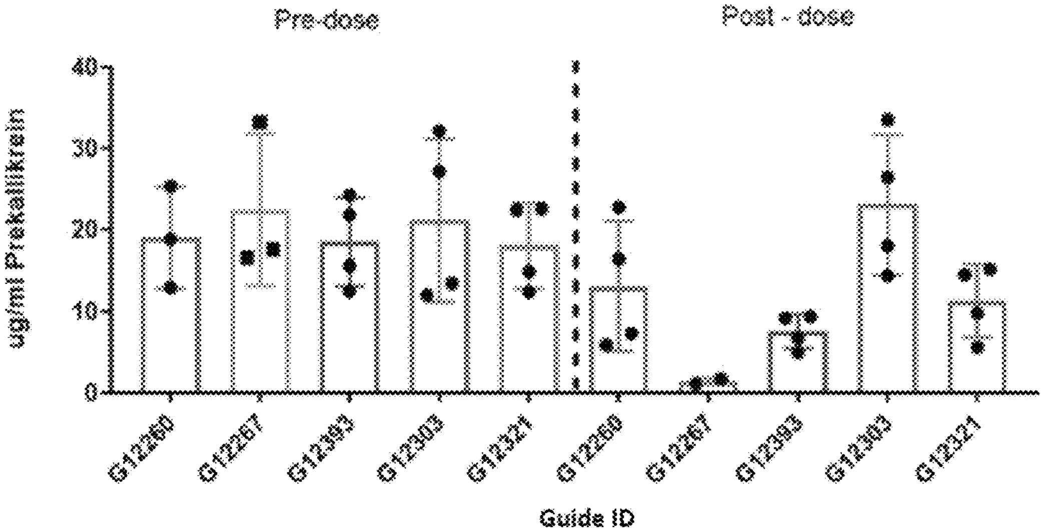
FIGS. 8B and 8C show KLKB1 protein levels measured using the ELISA and electrochemiluminescence-based array respectively in Hu KLKB1 mice (Example 6).
Figure 8C:
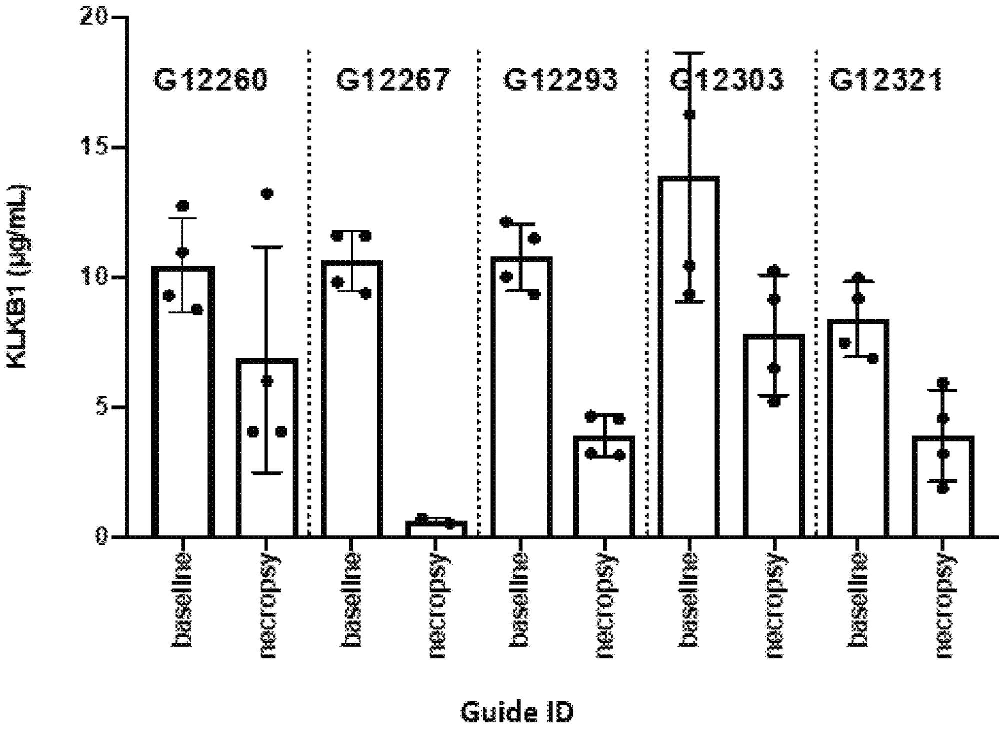

Editing observed in treated mice is shown in FIG. 8A and Table 16A.

TABLE 16A

In vivo Editing Data in Hu KLKB1 Mouse Model

| Guide | % Editing | Editing SD | N |
|---|---|---|---|
| G12260 | 32.9 | 10.96 | 4 |
| G12267 | 72.83 | 1.17 | 4 |
| G12293 | 43.05 | 5.59 | 4 |
| G12303 | 14.38 | 5.60 | 4 |
| G12321 | 35.53 | 11.11 | 4 |

Serum human KLKB1 protein levels, pre- and post-dose, were measured using the ELISA assay as described in Example 1. The results are shown in Table 16B and FIG. 8B.

TABLE 16B

Secreted KLKB1 protein levels in Hu KLKB1 Mouse Model

| Guide | Dose (mpk) | Pre-dose 1 | SD | Post-dose | SD | N |
|---|---|---|---|---|---|---|
| G12260 | 0.3 | 19.04 | 6.20 | 13.10 | 7.96 | 4 |
| G12267 | 0.3 | 22.48 | 9.32 | 1.42 | 0.41 | 4 |
| G12293 | 0.3 | 18.54 | 5.41 | 7.59 | 2.10 | 4 |
| G12303 | 0.3 | 21.21 | 9.98 | 23.11 | 8.58 | 4 |
| G12321 | 0.3 | 18.07 | 5.21 | 11.22 | 4.51 | 4 |

Serum human KLKB1 protein levels from the samples were measured using the electrochemiluminescence-based array (MSD) as described in Example 1 and compared to baseline levels. The results are shown in Table 17 and FIG. 8C.

TABLE 17

KLKB1 protein level in vivo

| Guide | Dose (mpk) | Pre-dose | SD | Post-dose | SD | % serum KD | N |
|---|---|---|---|---|---|---|---|
| G12260 | 0.3 | 10.44 | 0.43 | 6.84 | 0.09 | 38 | 4 |
| G12267 | 0.3 | 10.59 | 0.37 | BLOD* | — | 97** | 2 |
| G12293 | 0.3 | 10.74 | 0.24 | 3.92 | 0.04 | 64 | 4 |
| G12303 | 0.3 | 13.86 | 0.34 | 7.78 | 0.35 | 35** | 4 |
| G12321 | 0.3 | 8.38 | 0.1 | 3.92 | 0.16 | 55 | 4 |

*Below limit of detection;
**approximate

Figure 8D:
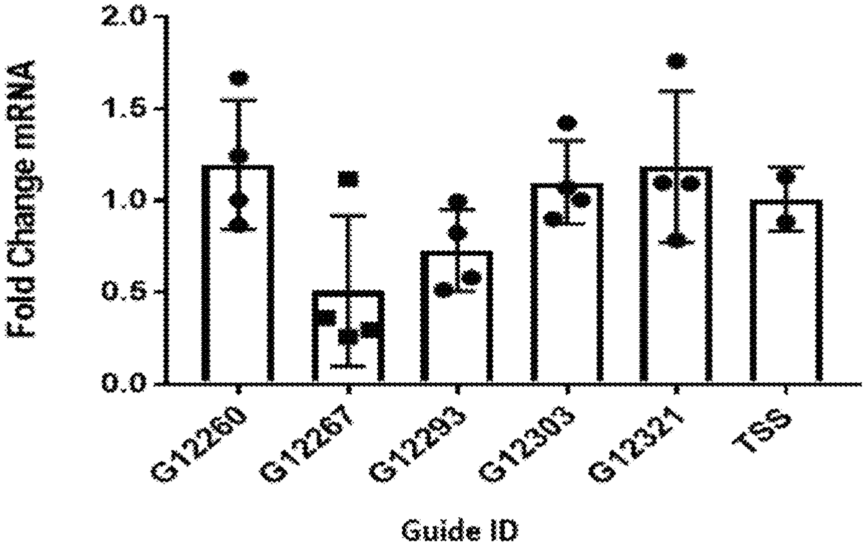
FIG. 8D shows the fold change of KLKB1 mRNA levels for each sequence in Hu KLKB1 mice.
Figure 9A:
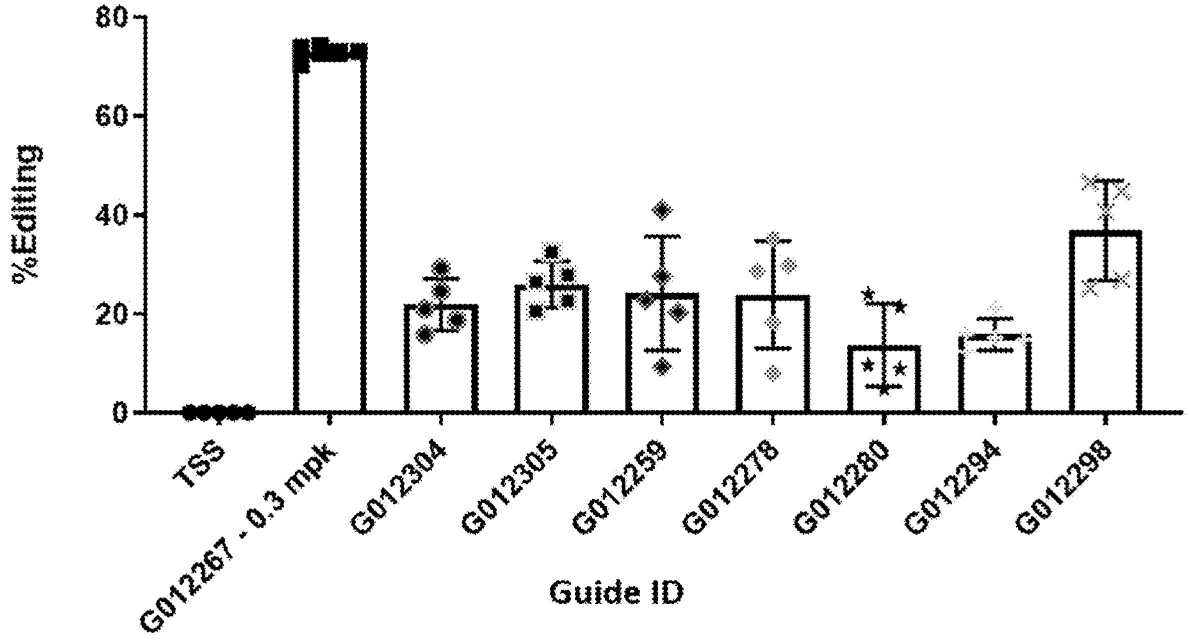
FIGS. 9A-9D show levels of KLKB1 editing (FIG. 9A), serum KLKB1 protein (prekallikrein and kallikrein) (FIG. 9B), percent TSS (FIG. 9C) in treated mice, and the correlation of percent liver editing to percent KLKB1 protein (FIG. 9D).
Figure 9B:
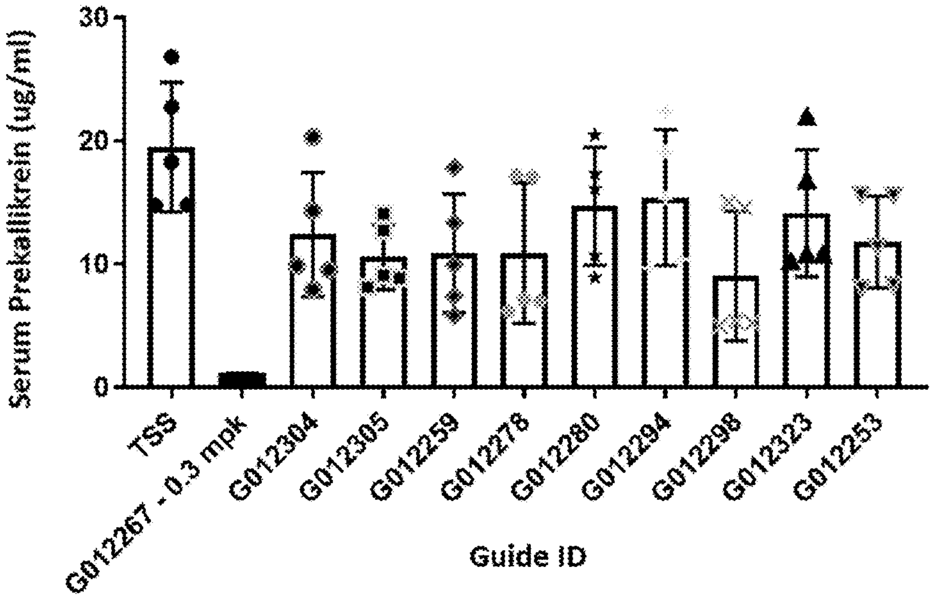
Figure 9C:
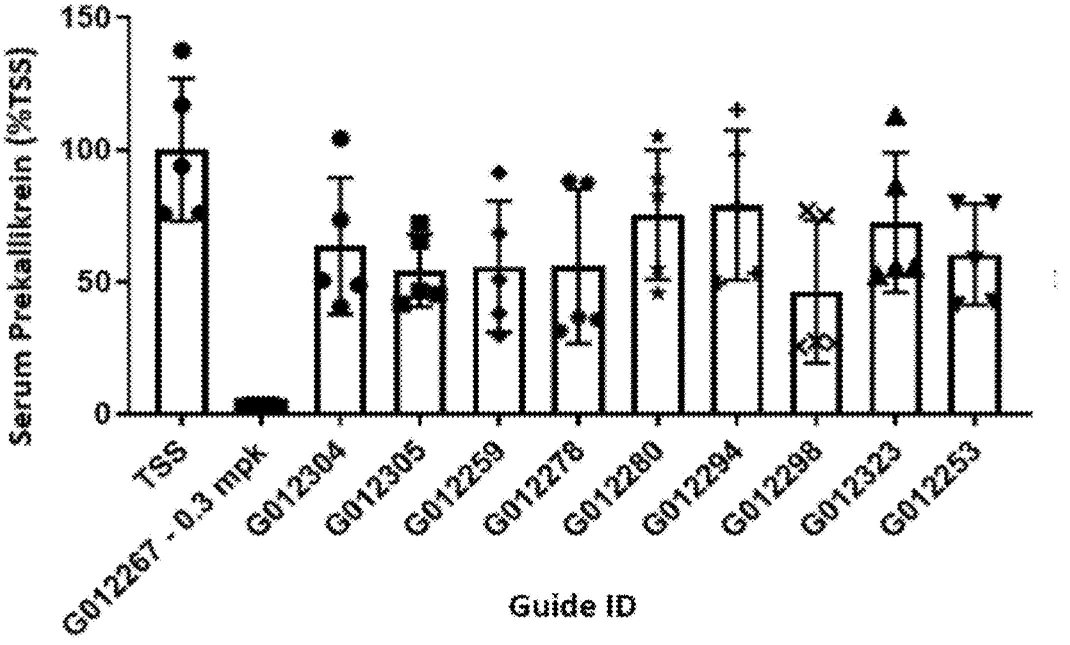
Figure 9D:
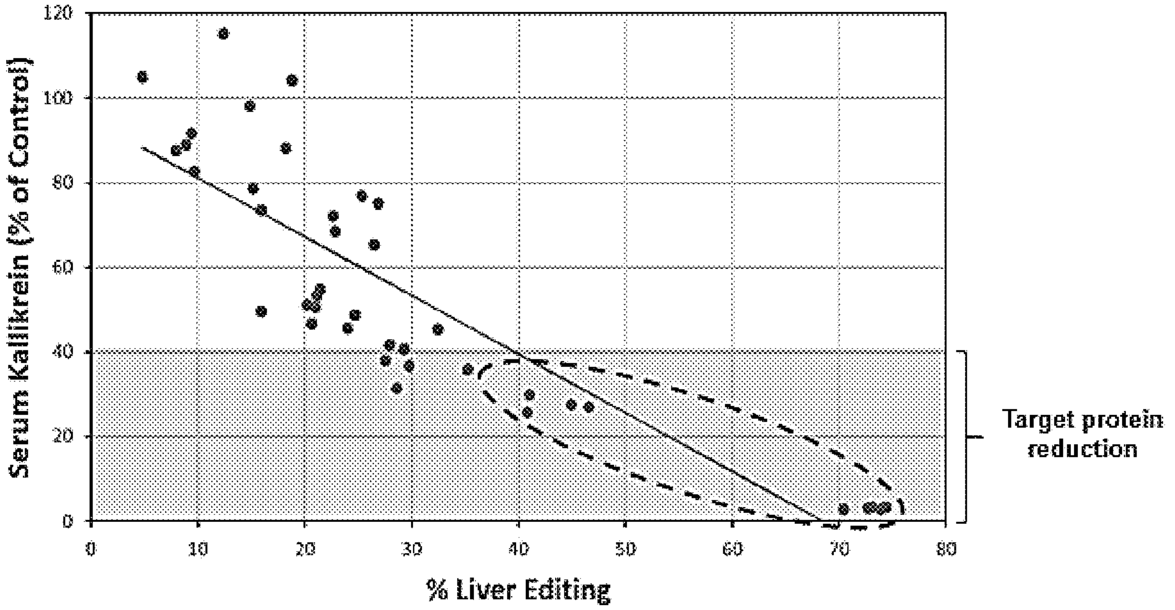

KLKB1 mRNA levels for each sequence were measured by quantitative PCR as described in Example 1 and shown in Table 18 and FIG. 8D. Protein reduction was confirmed by western blot analysis as described in Example 1.

TABLE 18 qPCR results

| Guide | Fold change | SD | N |
|---|---|---|---|
| G12260 | 1.20 | 0.35 | 4 |
| G12267 | 0.51 | 0.41 | 4 |
| G12293 | 0.73 | 0.22 | 4 |
| G12303 | 1.10 | 0.23 | 4 |
| G12321 | 1.18 | 0.41 | 4 |
| TSS | 1.01 | 0.17 | 2 |

Example 7. In Vivo Editing Activity of Human KLKB1 Guides in Hu KLKB1 Mouse Model Humanized KLKB1 mice described in Example 6 were used in this study and prepared using the same protocol.

There were 5 groups total (N=5 with 2 male and 3 female mice or vice versa). LNPs containing modified sgRNAs and mRNA encoding the Cas9 protein were dosed via the lateral tail vein at 0.3 mg/kg and characterized as described in Example 6.

At day 13 post-LNP administration, mice were euthanized. Liver tissue and blood was processed as described in Example 6 for sequencing and ELISA analysis.

Table 19 and FIGS. 9A-9D show levels of KLKB1 editing, serum prekallikrein protein (detected using an ELISA that detects both prekallikrein and kallikrein) (ug/ml), prekallikrein protein as percent of KLKB1 protein level in control TSS in treated mice, and the correlation of percent liver editing to percent prekallikrein protein, respectively. G012323 and G012253 guides were tested; however, editing was not detected due to a failure of the NGS method.

TABLE 19

Percent Editing and Serum Prekallikrein of Certain Guides in Hu-KLKB1 mouse model

| Dose (mpk) | Guide | Sample | % Edit | Serum Prekallikrein (ug/ml) | Serum Prekallikrein (% TSS Mean) |
|---|---|---|---|---|---|
| 0 | TSS | Mean | 0.1 | 19.49 | 100 |
| | | Animal 1 | 0.1 | 14.77 | 76 |
| | | Animal 2 | 0.1 | 18.29 | 94 |
| | | Animal 3 | 0.1 | 14.82 | 76 |
| | | Animal 4 | 0.1 | 26.82 | 138 |
| | | Animal 5 | 0.1 | 22.76 | 117 |
| 0.3 | G012304 | Mean | 21.9 | 12.4 | 64 |
| | | Animal 1 | 24.7 | 9.53 | 49 |
| | | Animal 2 | 21.0 | 9.88 | 51 |
| | | Animal 3 | 29.3 | 7.94 | 41 |
| | | Animal 4 | 18.8 | 20.32 | 104 |
| | | Animal 5 | 15.9 | 14.34 | 74 |
| | G012305 | Mean | 26.0 | 10.58 | 54 |
| | | Animal 1 | 20.6 | 9.09 | 47 |
| | | Animal 2 | 32.5 | 8.85 | 45 |
| | | Animal 3 | 27.9 | 8.13 | 42 |
| | | Animal 4 | 22.7 | 14.08 | 72 |
| | | Animal 5 | 26.5 | 12.75 | 65 |
| | G012259 | Mean | 24.2 | 10.88 | 56 |
| | | Animal 1 | 41.0 | 5.83 | 30 |
| | | Animal 2 | 20.3 | 9.96 | 51 |
| | | Animal 3 | 27.6 | 7.42 | 38 |
| | | Animal 4 | 9.4 | 17.83 | 91 |
| | | Animal 5 | 22.8 | 13.36 | 69 |
| | G012278 | Mean | 24.0 | 10.91 | 56 |
| | | Animal 1 | 29.8 | 7.15 | 37 |
| | | Animal 2 | 35.2 | 6.99 | 36 |
| | | Animal 3 | 28.6 | 6.16 | 32 |
| | | Animal 4 | 18.2 | 17.21 | 88 |
| | | Animal 5 | 8.0 | 17.07 | 88 |
| | G012280 | Mean | 13.8 | 14.71 | 75 |
| | | Animal 1 | 21.4 | 10.70 | 55 |
| | | Animal 2 | 24.0 | 8.92 | 46 |
| | | Animal 3 | 4.8 | 20.46 | 105 |
| | | Animal 4 | 8.9 | 17.34 | 89 |
| | | Animal 5 | 9.7 | 16.11 | 83 |
| | G012294 | Mean | 15.9 | 15.4 | 79 |
| | | Animal 1 | 21.1 | 10.38 | 53 |
| | | Animal 2 | 15.9 | 9.69 | 50 |
| | | Animal 3 | 15.2 | 15.37 | 79 |
| | | Animal 4 | 14.9 | 19.13 | 98 |
| | | Animal 5 | 12.4 | 22.44 | 115 |
| | G012298 | Mean | 36.9 | 9.05 | 46 |
| | | Animal 1 | 40.8 | 4.99 | 26 |
| | | Animal 2 | 46.6 | 5.26 | 27 |
| | | Animal 3 | 44.9 | 5.38 | 28 |
| | | Animal 4 | 25.3 | 15.01 | 77 |
| | | Animal 5 | 26.9 | 14.61 | 75 |

Example 8. In Vivo Dose Response of KLKB1 Gene Editing in Hu KLKB1 Mouse Model

Humanized mice described in Example 6 were used in this study and prepared using the same protocol. There were 5 groups total (N=5 with 2 male and 3 female mice or vice versa). LNPs containing G12267 and mRNA encoding the Cas9 protein were dosed at 0.3, 0.1, 0.03 and 0.01 mg per kg bodyweight and characterized as described in Example 6.

At day 13 post-LNP administration, mice were euthanized. Liver tissue was processed as described in Example 6 for DNA sequencing. Blood was processed as described in Example 6 and secreted human prekallikrein was measured via an ELISA, which detects prekallikrein and kallikrein (also, called total kallikrein), as described in Example 1.

For RNA analysis, liver tissue was lysed using a Zymo Research Bashing Bead Lysis Rack, and RNA was extracted using the Qiagen RNeasy® Mini Kit (Qiagen, Cat. 74106) according to the manufacturer's protocol. RNA was quantified using a Nanodrop® 8000 (ThermoFisher Scientific, Cat. ND-8000-GL). RNA samples were stored at −20° C. prior to use.

The SuperScript® III Platinum One-Step qRT-PCR Kit (Invitrogen, Cat. 11732-088) was used to create the PCR reactions. Quantitative PCR probes targeting Hu KLKB1 and internal control Ms PPIB were used in the reactions. The quantitative PCR assay was performed according to the manufacturer's specifications, scaled to the appropriate reaction volume, as well as using the Hu KLKB1 and Ms PPIB probes specified above. The StepOnePlus Real-Time PCR System (ThermoFisher Scientific, Cat. 4376600) was used to perform the real-time PCR reaction and transcript quantification according to the manufacturer's protocol.

Hu KLKB1 mRNA was quantified using a standard curve starting at 20 ng/uL of pooled mRNA from the vehicle control group, with five further 3-fold dilutions ending at 0.06 ng/μL. Ct values were determined from the StepOne-Plus® Real-Time PCR System. Reduction of total secreted human prekallikrein protein for cells treated with KLKB1 reagents was determined by ELISA as described in Example 1.

Figure 10:
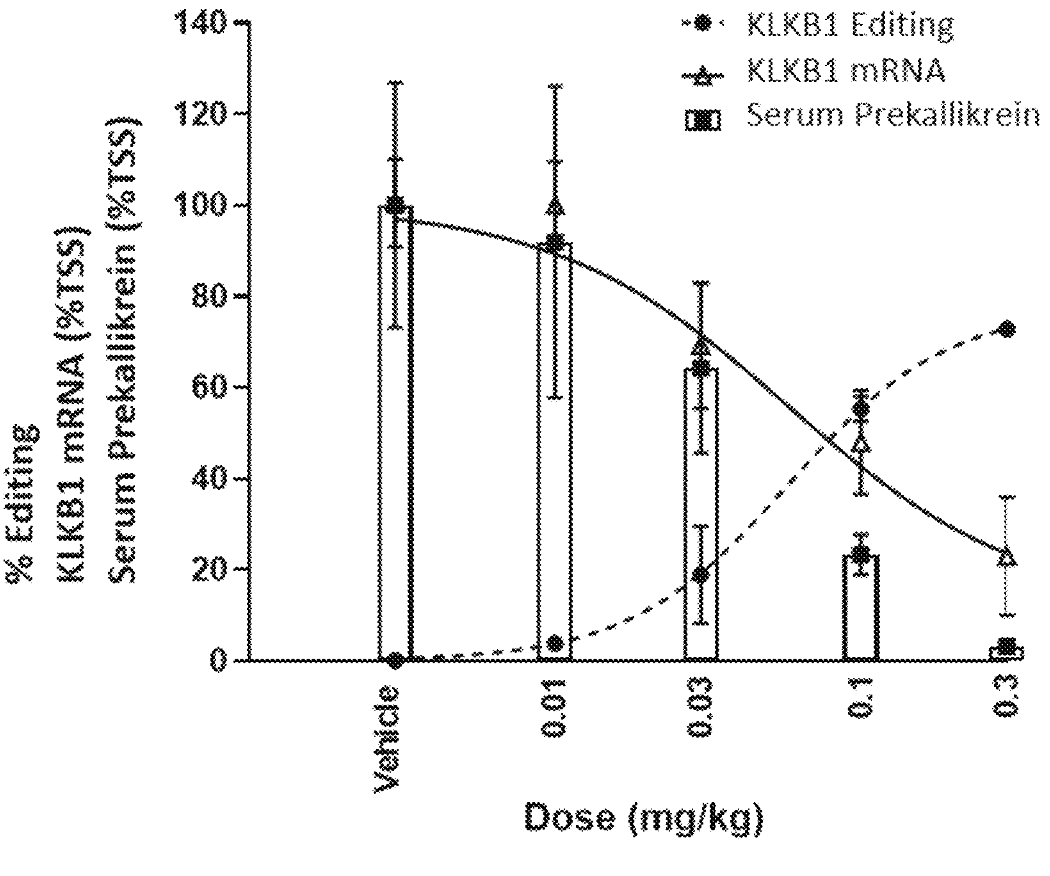
FIG. 10 shows dose-dependent levels of KLKB1 gene editing, percent knockdown of KLKB1 mRNA, and plasma kallikrein in Hu KLKB1 mouse model.

Table 20 and FIG. 10 show percent editing, serum prekallikrein levels as a percent of TSS vehicle control treated mice, and mRNA transcript levels as a percent of TSS vehicle control treated animals.

TABLE 20

Percent Editing, KLKB1 mRNA (% of basal level) and Serum Prekallikrein Protein Levels (% of basal level) in Hu KLKB1 Mouse Model

| Guide | Dose (mpk) | | % Editing | % TSS protein | % TSS mRNA | SD |
|---|---|---|---|---|---|---|
| TSS | 0 | Mean | 0.1 | 100 | 100.5 | 9.7 |
| | | Animal 1 | 0.1 | 75.8 | | |
| | | Animal 2 | 0.1 | 93.8 | | |
| | | Animal 3 | 0.1 | 76.0 | | |
| | | Animal 4 | 0.1 | 137.6 | | |
| | | Animal 5 | 0.1 | 116.8 | | |
| G12267 | 0.01 | Mean | 3.9 | 91.9 | 100.1 | 9.5 |
| | | Animal 1 | 4.4 | 55.3 | | |
| | | Animal 2 | 3.8 | 57.3 | | |
| | | Animal 3 | 4.5 | 126.2 | | |
| | | Animal 4 | 4.2 | 122.2 | | |
| | | Animal 5 | 2.6 | 98.6 | | |
| | 0.03 | Mean | 19.0 | 64.2 | 69.3 | 13.8 |
| | | Animal 1 | 22.1 | 38.6 | | |
| | | Animal 2 | 0.3 | 51.0 | | |

TABLE 20-continued

| Percent Editing, KLKB1 mRNA (% of basal level) and Serum Prekallikrein Protein Levels (% of basal level) in Hu KLKB1 Mouse Model | | | | | | |
|---|---|---|---|---|---|---|
| Guide | Dose (mpk) | | % Editing | % TSS protein | % TSS mRNA | SD |
| | | Animal 3 | 26.9 | 78.9 | | |
| | | Animal 4 | 21.3 | 80.5 | | |
| | | Animal 5 | 24.3 | 72.2 | | |
| | 0.1 | Mean | 55.4 | 23.3 | 48 | 11.4 |
| | | Animal 1 | 52.1 | 17.6 | | |
| | | Animal 2 | 52.7 | 19.6 | | |
| | | Animal 3 | 56.5 | 25.3 | | |
| | | Animal 4 | 57.5 | 25.6 | | |
| | | Animal 5 | 58.0 | 28.3 | | |
| | 0.3 | Mean | 72.9 | 3.1 | 23 | 13 |
| | | Animal 1 | 73.9 | 2.7 | | |
| | | Animal 2 | 70.4 | 2.9 | | |
| | | Animal 3 | 72.7 | 3.1 | | |
| | | Animal 4 | 73.1 | 3.4 | | |
| | | Animal 5 | 74.3 | 3.4 | | |

Example 9. Vascular Leakage Study

A study was performed to evaluate KLKB1 gene editing, total kallikrein protein expression, and vascular leakage in humanized mice. Humanized mice described in Example 1 were used in this study. There were 6 groups (N=5 with 2 male, 3 female mice per group). Animals were weighed and dosed at volumes specific to individual body weight.

LNPs containing a modified KLKB1 targeting sgRNA (G12267) and the Cas9 mRNA were dosed via the lateral tail vein at 0.03 mg/kg, 0.1 mg/kg, or 0.3 mg/kg based on total RNA cargo in a volume of 10 ml per kilogram body weight or vehicle control (TSS).

At one day prior to the vascular leakage study, blood was collected and processed as described in Example 6, and secreted human prekallikrein was measured via an ELISA, which detects prekallikrein and kallikrein (also, called total kallikrein), as described in Example 1.

The vascular leakage assay was performed as described in Example 1. At necropsy, liver tissue was collected and DNA extracted as described in Example 6 to measure KLKB1 editing. For dye quantification in the vascular leakage model, colon tissue was collected and processed as described in Example 1.

Figure 11A:
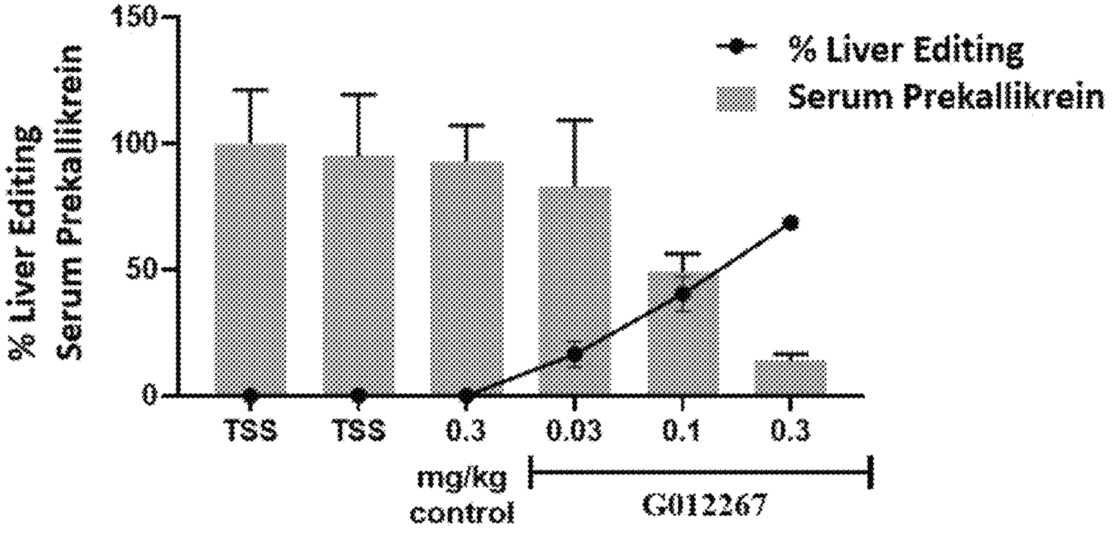
FIG. 11A shows levels of KLKB1 gene editing and plasma kallikrein in a dose response assay at after treatment with the indicated doses of sgRNA in Hu KLKB1 mouse model.
Figure 11B:
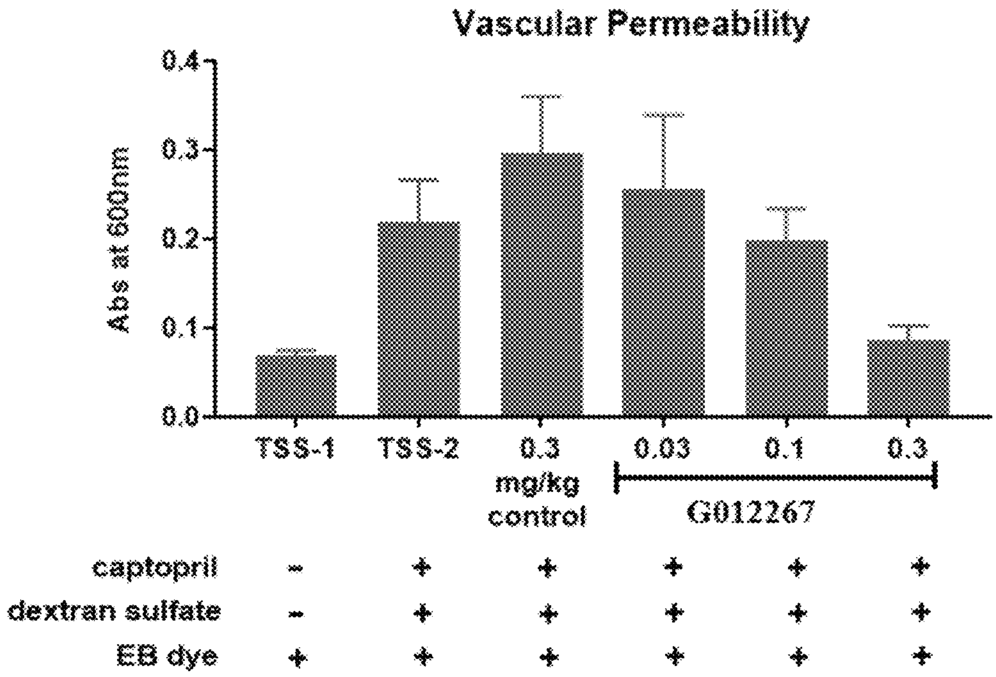
FIG. 11B shows levels of absorbance at 600 nm light to detect Evans blue (EB) dye from colon samples in a dose response vascular permeability assay in response to treatment with permeabilizing agents at after treatment with the indicated doses of sgRNA in the Hu KLKB1 mouse model.
Figure 12A:
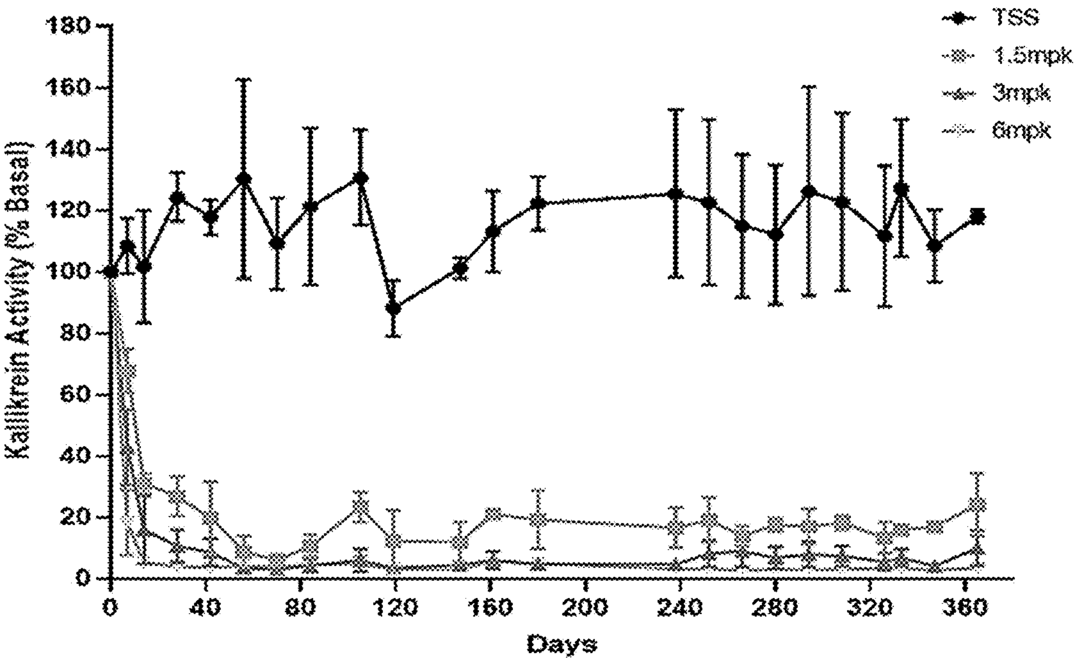
FIGS. 12A-12B show in vivo dose-dependent reductions in circulating total kallikrein activity (FIG. 12A) and protein levels (FIG. 12B), respectively, after a single dose administration of CRISPR/Cas9 components at 1.5 mg/kg, 3 mg/kg, or 6 mg/kg with G013901 in cynomolgus monkeys.
Figure 12B:
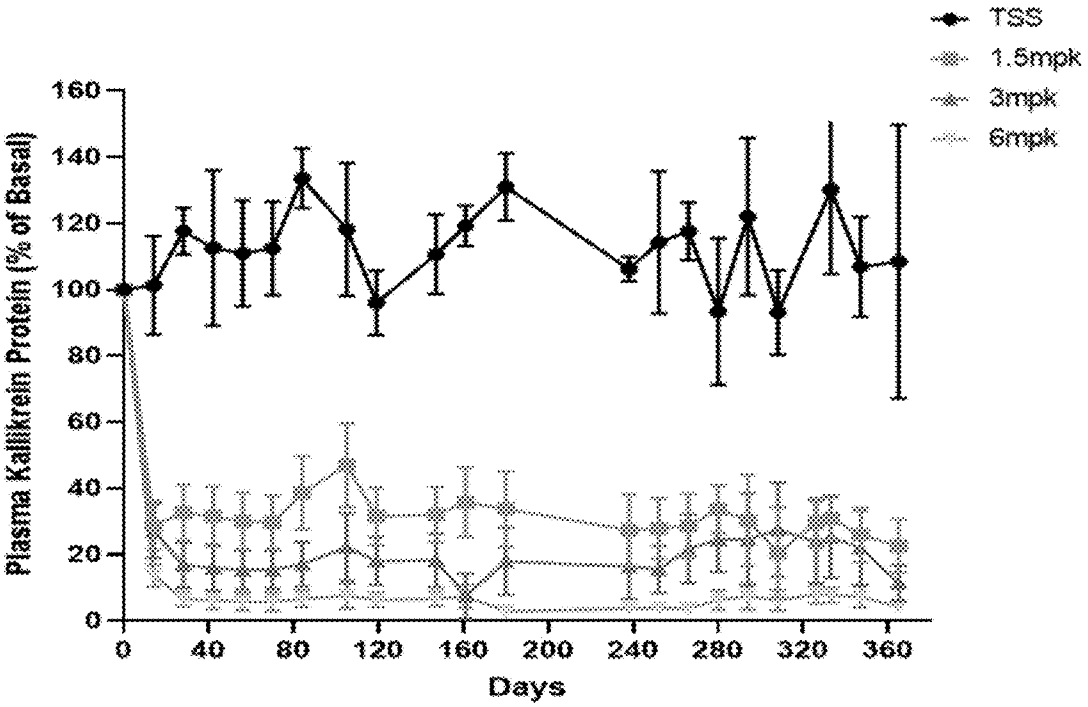
Figure 13A:
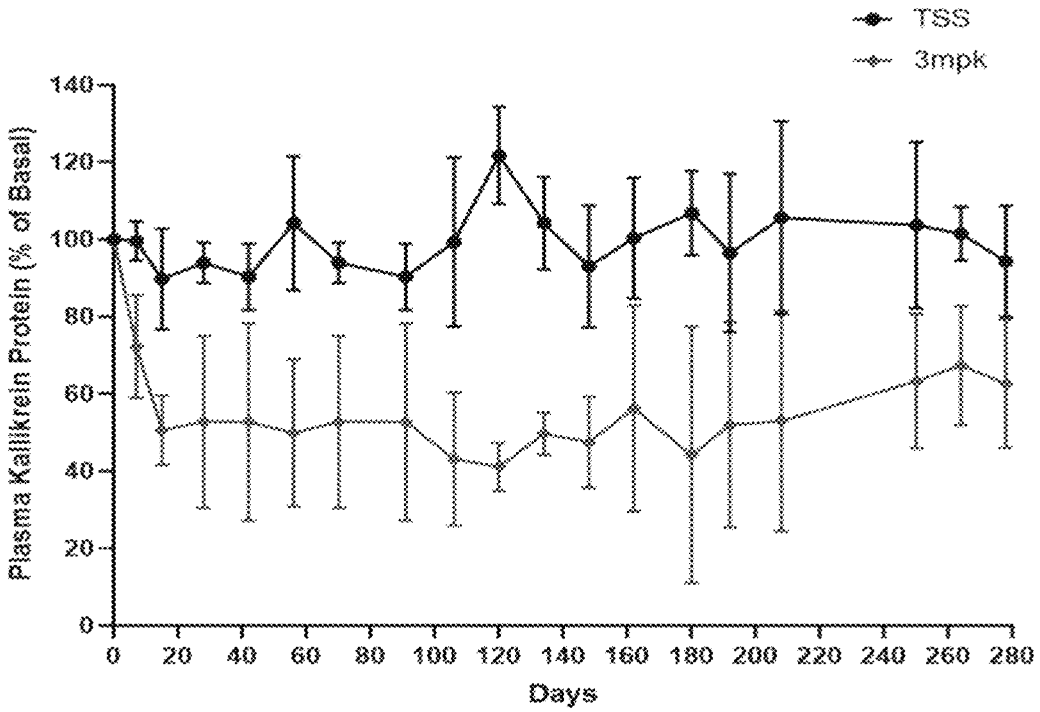
FIGS. 13A-13B show in vivo reductions in circulating total kallikrein activity (FIG. 13A) and protein levels (FIG. 13B), respectively, after a single dose administration of CRISPR/Cas9 components at the indicated dosages with G012267 in cynomologous monkeys.
Figure 13B:
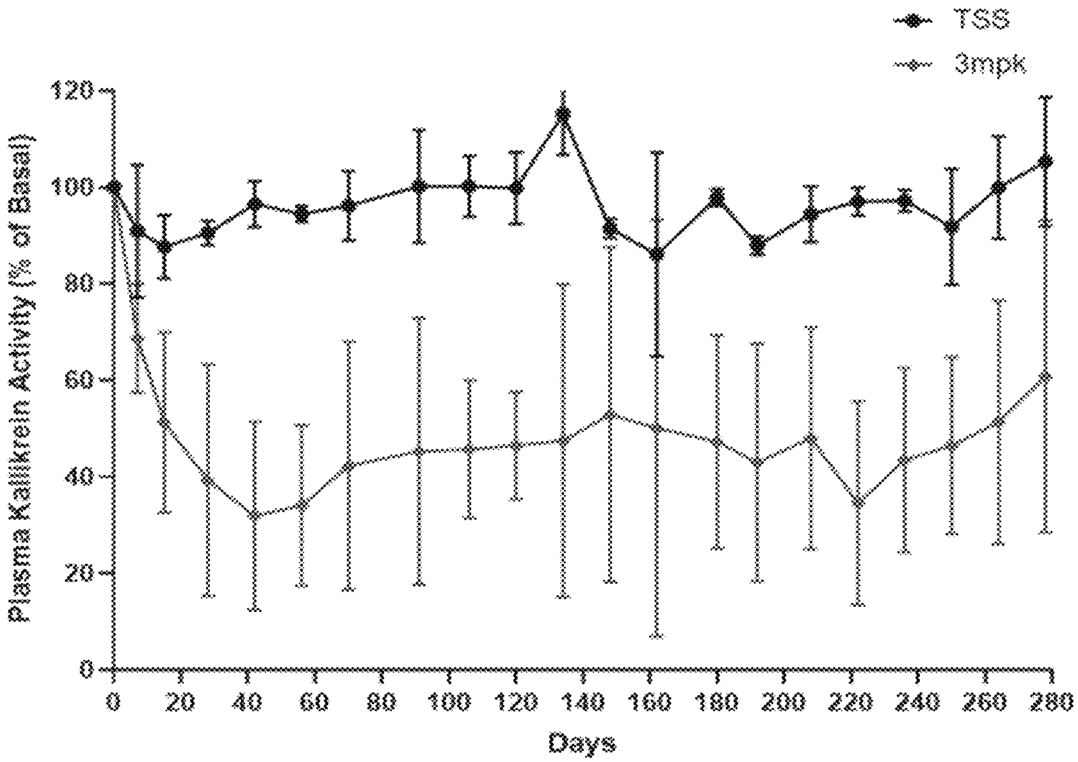

The results for percent editing, serum hu KLKB1 protein levels, and vascular leakage are shown in Table 21 and FIGS. 11A-11B.

TABLE 21

| Percent editing, KLKB1 protein levels, and vascular leakage in huKLKB1 mice | | | | |
|---|---|---|---|---|
| | Dose (mg/kg) | % Editing | Serum Prekallikrein (ug/ml) | Colon (OD) |
| TSS-1 | 0 | 0.02 | 100.00 | 0.07 |
| TSS-2 | 0 | 0.06 | 94.92 | 0.22 |
| Control | 0.3 | 0.1 | 92.99 | 0.30 |
| G012267 | 0.03 | 16.48 | 82.97 | 0.26 |
| G012267 | 0.1 | 40.46 | 48.97 | 0.20 |
| G012267 | 0.3 | 68.66 | 13.88 | 0.09 |

A separate study was conducted using similar methods to assess the percent editing, serum prekallikrein levels, and vascular leakage for durability over a 9-month period. Mice were dosed with modified KLKB1 targeting sgRNA (G12267) and the Cas9 mRNA or a non-targeting sgRNA were dosed via the lateral tail vein at 0.1 mg/kg or 0.3 mg/kg based on total RNA cargo in a volume of 10 ml per kilogram body weight. The durability of the dose response was observed where increased editing, decreased protein levels, and decreased vascular leakage levels were maintained for the length of the study.

Example 10. In Vivo Testing of KLKB1 Gene Editing in Non-Human Primates (NHPs)

In this example, a study was performed to evaluate KLKB1 gene editing and total kallikrein protein expression, and total kallikrein activity levels in cynomolgus monkeys following administration of CRISPR/Cas9 lipid nanoparticles (LNP) with mRNA for Cas9 protein and various guides to the KLKB1 gene. Cynomolgus monkeys were treated in cohorts of n=3. This study was conducted with LNP formulations according to Example 1. Each LNP formulation contained a polyadenylated Cas9 mRNA (comprising SEQ ID NO: 516) and gRNA (G013901, a cynomolgus specific KLKB1 guide RNA) with an mRNA:gRNA ratio of 2:1 by weight. Animals were dosed at 1.5, 3, or 6 mg per kg doses based on total RNA cargo. Indel formation (percent editing) was measured by NGS. Total kallikrein activity and serum kallikrein protein level were measured as described in Example 1.

The study showed that knockout of KLKB1, which is part of a biological pathway that results in release of bradykinin, with G013901 produced up to a 90% reduction in kallikrein activity in NHP groups, or more, a robust response that exceeds the target activity shown to achieve a therapeutically meaningful impact on HAE attack rates (60% kallikrein activity reduction; Banerji, 2017). This study showed a dose-dependent correlation between increased editing rates, reduced plasma kallikrein levels, and reduced kallikrein activity. The response has been durable through one year in NHPs. Circulating kallikrein protein and activity levels are provided in Tables 22 and 23 and FIGS. 12A-12B.

TABLE 22

| Kallikrein Activity (% of basal activity) | | | | | | | | |
|---|---|---|---|---|---|---|---|---|
| | TSS (n = 3) | | 1.5 mpk (n = 3) | | 3 mpk (n = 3) | | 6 mpk (n = 3) | |
| Day | Mean | SD | Mean | SD | Mean | SD | Mean | SD |
| 0 | 100 | 0 | 100 | 0 | 100 | 0 | 100 | 0 |
| 7 | 108.4 | 9 | 67.8 | 7 | 42.8 | 12.4 | 18.2 | 10.6 |
| 14 | 101.8 | 18.3 | 31.1 | 3.2 | 15.9 | 11 | 5.3 | 1.6 |
| 28 | 124.4 | 7.9 | 26.8 | 6.5 | 10.6 | 5.4 | 3.9 | 1.4 |
| 42 | 117.8 | 5.8 | 19.8 | 11.9 | 8.6 | 4.4 | 3.6 | 0.4 |
| 56 | 130.3 | 32.5 | 8.8 | 5 | 3.4 | 0.6 | 4.2 | 2.2 |
| 70 | 109.2 | 15 | 6 | 1.7 | 3 | 0.4 | 3.9 | 1.6 |
| 84 | 121.3 | 25.7 | 10.6 | 3.8 | 4.2 | 2.1 | 4.7 | 2.5 |
| 105 | 130.8 | 15.5 | 23.3 | 4.9 | 6 | 3.6 | 4.7 | 2.5 |
| 119 | 88.2 | 9.1 | 12.2 | 10.2 | 3.4 | 0.5 | 3 | 0.5 |
| 147 | 101.1 | 3.3 | 11.9 | 6.6 | 4.5 | 1.4 | 3 | 0.5 |
| 161 | 113.2 | 13.4 | 21 | 1.8 | 6 | 2.8 | 5.6 | 1.8 |
| 180 | 122.3 | 8.7 | 19.2 | 9.5 | 4.7 | 1 | 5 | 1.9 |
| 238 | 125.5 | 27.3 | 16.6 | 6.5 | 4.7 | 1.4 | 3.2 | 0.7 |
| 252 | 122.7 | 27 | 19.1 | 7.3 | 8.2 | 4.4 | 3.1 | 0.7 |
| 266 | 115 | 23.3 | 13.9 | 3.3 | 8.9 | 5.2 | 2.7 | 0.6 |
| 280 | 112.2 | 22.7 | 17.5 | 2.3 | 6.8 | 3.6 | 3 | 1 |

TABLE 22-continued

| Kallikrein Activity (% of basal activity) | | | | | | | | |
|---|---|---|---|---|---|---|---|---|
| | TSS (n = 3) | | 1.5 mpk (n = 3) | | 3 mpk (n = 3) | | 6 mpk (n = 3) | |
| Day | Mean | SD | Mean | SD | Mean | SD | Mean | SD |
| 294 | 126.3 | 34.1 | 17 | 5.8 | 7.9 | 4.1 | 2.9 | 0.6 |
| 308 | 122.9 | 28.9 | 18.2 | 2.3 | 7.4 | 3.3 | 3 | 0.8 |
| 326 | 111.6 | 23 | 13.3 | 5.2 | 5.5 | 2.9 | 3.5 | 0.4 |
| 333 | 127.3 | 22.4 | 15.9 | 1.8 | 6.8 | 2.8 | 3.3 | 0.4 |
| 347 | 108.4 | 11.7 | 16.9 | 1 | 4.1 | 1.8 | 2.9 | 0.3 |
| 365 | 118 | 2.2 | 24.1 | 10.2 | 10 | 5.7 | 3.4 | 0.7 |

TABLE 23

| Plasma Kallikrein Protein Levels (% of basal level) | | | | | | | | |
|---|---|---|---|---|---|---|---|---|
| | TSS (n = 3) | | 1.5 mpk (n = 3) | | 3 mpk (n = 3) | | 6 mpk (n = 3) | |
| Day | Mean | SD | Mean | SD | Mean | SD | Mean | SD |
| 0 | 100 | 0 | 100 | 0 | 100 | 0 | 100 | 0 |
| 14 | 101.3 | 14.9 | 28.8 | 7.4 | 27.1 | 8.2 | 13.7 | 3.3 |
| 28 | 117.7 | 7 | 32.7 | 8.5 | 16.9 | 6.8 | 6.6 | 2.3 |
| 42 | 112.6 | 23.5 | 31.5 | 9.1 | 16 | 7 | 6.3 | 2.8 |
| 56 | 111 | 16 | 30.1 | 8.8 | 15.4 | 6 | 5.8 | 2.5 |
| 70 | 112.5 | 14.1 | 29.8 | 8 | 15.4 | 5.8 | 5.8 | 2.8 |
| 84 | 133.6 | 9 | 38.7 | 11.1 | 17.1 | 6.7 | 6.7 | 2.5 |
| 105 | 118.2 | 20.1 | 47 | 12.7 | 22.3 | 10.3 | 7.6 | 3.8 |
| 119 | 96 | 9.8 | 31.6 | 8.7 | 18.1 | 7.2 | 6.4 | 2.2 |
| 147 | 110.7 | 12 | 32.1 | 8.3 | 18.3 | 8.1 | 6.7 | 2.2 |
| 161 | 119.3 | 6.1 | 35.8 | 10.5 | 7.5 | 6.8 | 7.4 | 3.5 |
| 180 | 131 | 10.1 | 33.8 | 11.4 | 18 | 10.1 | 2.9 | 1 |
| 238 | 106.2 | 3.7 | 27.4 | 10.8 | 16.4 | 9.8 | 3.7 | 0.9 |
| 252 | 114.3 | 21.4 | 27.9 | 9.1 | 15.6 | 7.1 | 3.9 | 0.8 |
| 266 | 117.6 | 8.7 | 28.7 | 9.7 | 21.8 | 10.4 | 3.7 | 0.5 |
| 280 | 93.4 | 22.1 | 33.7 | 7.1 | 24.6 | 9.8 | 6.3 | 2.9 |
| 294 | 122.1 | 23.7 | 30.4 | 13.8 | 24.6 | 14 | 7.4 | 4 |
| 308 | 93.2 | 12.8 | 20.6 | 13.8 | 27.6 | 14.2 | 6.2 | 3.1 |
| 326 | N/A | | 29.7 | 7.3 | 23.8 | 12.5 | 8 | 2.8 |
| 333 | 130.2 | 25.5 | 30.9 | 6.4 | 25.3 | 12.4 | 7.8 | 2.3 |
| 347 | 106.9 | 15 | 26 | 8.2 | 22.1 | 11.2 | 7.3 | 3.2 |
| 365 | 108.5 | 41.3 | 22.7 | 8 | 11.4 | 5.3 | 4.3 | 1.6 |

Tests of select NHIP serum samples found no observed impact on coagulation pathway biomarkers with KLKB1 knockout in NHPs at weeks 10 or 15 (based on measuring prothrombin, APTT, and fibrinogen (all at week 10), and Factor XII (at week 15)) when comparing TSS buffer control groups to treated groups.

The NHP study was repeated to evaluate KLKB1 total kallikrein protein expression, and total kallikrein activity levels in cynomolgus monkeys using guide G012267 which includes a guide sequence fully complementary to human KLKB1. The guide sequence of G012267 has one nucleotide difference when compared to the G013901 which has a guide sequence fully complementary to cynomolgus KLKB1. The experimental protocol and LNP formulations in this study were essentially the same as described in the above experiment, except animals (n=3) were only dosed at 3 mg per kg based on total RNA cargo. Total kallikrein activity and serum kallikrein protein levels were measured using the methods described in Example 1.

The study showed that knockdown of KLKB1 with G012267 produced up to a 65% reduction in kallikrein activity in NHP groups. The response was durable through 9 months in NHPs. Circulating kallikrein protein and activity levels are provided in Tables 24 and 25 and in FIGS. 13A-13B.

TABLE 24

| Kallikrein Activity (% of basal activity) | | | | |
|---|---|---|---|---|
| | TSS (n = 3) | | 3 mpk (n = 3) | |
| Day | Mean | Std. Dev | Mean | Std. Dev |
| 0 | 100 | N/A | 100 | N/A |
| 7 | 90.9 | 13.7 | 68.7 | 11.3 |
| 15 | 87.7 | 6.6 | 51.3 | 18.7 |
| 28 | 90.5 | 2.5 | 39.3 | 24 |
| 42 | 96.5 | 4.8 | 31.9 | 19.5 |
| 56 | 94.5 | 1.6 | 34.1 | 16.7 |
| 70 | 96.2 | 7.2 | 42.3 | 25.7 |
| 91 | 100.2 | 11.7 | 45.3 | 27.6 |
| 106 | 100.2 | 6.3 | 45.7 | 14.3 |
| 120 | 99.8 | 7.4 | 46.5 | 11.1 |
| 134 | 115.2 | 8.5 | 47.5 | 32.4 |
| 148 | 91.5 | 2 | 52.9 | 34.7 |
| 162 | 86.1 | 21.1 | 50.1 | 43.2 |
| 180 | 97.9 | 1.8 | 47.3 | 22.1 |
| 192 | 87.9 | 1.9 | 43 | 24.6 |
| 208 | 94.4 | 5.8 | 48 | 23 |
| 222 | 97 | 2.9 | 34.6 | 21.1 |
| 236 | 97.2 | 2.2 | 43.5 | 19.1 |
| 250 | 91.8 | 12 | 46.5 | 18.3 |
| 264 | 99.9 | 10.6 | 51.3 | 25.2 |
| 278 | 105.3 | 13.4 | 60.8 | 32.3 |

TABLE 25

| Plasma Kallikrein Protein Levels (% of basal level) | | | | |
|---|---|---|---|---|
| | TSS (n = 3) | | 3 mpk (n = 3) | |
| Day | Mean | Std. Dev | Mean | Std. Dev |
| 0 | 100 | N/A | 100 | N/A |
| 7 | 99.6 | 5.1 | 72.3 | 13.3 |
| 15 | 89.7 | 13.1 | 50.6 | 9 |
| 28 | 93.9 | 5.2 | 52.8 | 22.3 |
| 42 | 90.3 | 8.6 | 52.7 | 25.5 |
| 56 | 104.2 | 17.3 | 49.9 | 19.1 |
| 70 | 93.9 | 5.2 | 52.8 | 22.3 |
| 91 | 90.3 | 8.6 | 52.7 | 25.5 |
| 106 | 99.3 | 21.9 | 43.1 | 17.3 |
| 120 | 121.7 | 12.6 | 41.1 | 6.2 |
| 134 | 104.2 | 12 | 49.7 | 5.5 |
| 148 | 93 | 15.8 | 47.5 | 11.8 |
| 162 | 100.3 | 15.7 | 56.2 | 26.7 |
| 180 | 106.8 | 10.9 | 44.1 | 33.2 |
| 192 | 96.5 | 20.5 | 52 | 26.6 |
| 208 | 105.6 | 25 | 52.9 | 28.5 |
| 250 | 103.7 | 21.5 | 63.3 | 17.4 |
| 264 | 101.4 | 7 | 67.3 | 15.4 |
| 278 | 94.3 | 14.4 | 62.6 | 16.7 |

SEQUENCE LISTING (605 sequences)

SEQ ID NO: 1 - RNA, 20 nt, Homo sapiens
  source 1..20: mol_type = genomic RNA
acaggaaactgtagcaaaca

SEQ ID NO: 2 - RNA, 20 nt, Homo sapiens
  source 1..20: mol_type = genomic RNA
atagataattcacttaccac

SEQ ID NO: 3 - RNA, 20 nt, Homo sapiens
  source 1..20: mol_type = genomic RNA
tacatccccacctctgaaga

SEQ ID NO: 4 - RNA, 20 nt, Homo sapiens
  source 1..20: mol_type = genomic RNA
tcttgaggagtagaggaact

SEQ ID NO: 5 - RNA, 20 nt, Homo sapiens
  source 1..20: mol_type = genomic RNA
accaggtaaagttcttttgc

SEQ ID NO: 6 - RNA, 20 nt, Homo sapiens
  source 1..20: mol_type = genomic RNA
gggtaaattttagaatggca

SEQ ID NO: 7 - RNA, 20 nt, Homo sapiens
  source 1..20: mol_type = genomic RNA
atttacccgggagttgactt

SEQ ID NO: 8 - RNA, 20 nt, Homo sapiens
  source 1..20: mol_type = genomic RNA
tacccgggagttgactttgg

SEQ ID NO: 9 - RNA, 20 nt, Homo sapiens
  source 1..20: mol_type = genomic RNA
tctttgagattgtgtaacac

SEQ ID NO: 10 - RNA, 20 nt, Homo sapiens
  source 1..20: mol_type = genomic RNA
ctttgagattgtgtaacact

SEQ ID NO: 11 - RNA, 20 nt, Homo sapiens
  source 1..20: mol_type = genomic RNA
tttgagattgtgtaacactg

SEQ ID NO: 12 - RNA, 20 nt, Homo sapiens
  source 1..20: mol_type = genomic RNA
tacataccagtgtaattcaa

SEQ ID NO: 13 - RNA, 20 nt, Homo sapiens
  source 1..20: mol_type = genomic RNA
ctccaactaggattgcgtat

SEQ ID NO: 14 - RNA, 20 nt, Homo sapiens
  source 1..20: mol_type = genomic RNA
aggattgcgtatgggacaca

SEQ ID NO: 15 - RNA, 20 nt, Homo sapiens
  source 1..20: mol_type = genomic RNA
ggattgcgtatgggacacaa

SEQ ID NO: 16 - RNA, 20 nt, Homo sapiens
  source 1..20: mol_type = genomic RNA
gttactcagcacctttatag

SEQ ID NO: 17 - RNA, 20 nt, Homo sapiens
  source 1..20: mol_type = genomic RNA
tgcctattaaagtacagtcc

SEQ ID NO: 18 - RNA, 20 nt, Homo sapiens
  source 1..20: mol_type = genomic RNA
ctatggatggttctccaact

SEQ ID NO: 19 - RNA, 20 nt, Homo sapiens
  source 1..20: mol_type = genomic RNA
gatgtttggcgcatctatag

SEQ ID NO: 20 - RNA, 20 nt, Homo sapiens
  source 1..20: mol_type = genomic RNA
atgcgccaaacatcctgcag

SEQ ID NO: 21 - RNA, 20 nt, Homo sapiens
  source 1..20: mol_type = genomic RNA
ctcctttataaatgtctcga

SEQ ID NO: 22 - RNA, 20 nt, Homo sapiens
  source 1..20: mol_type = genomic RNA
tgttactggtgcaccttttt

SEQ ID NO: 23 - RNA, 20 nt, Homo sapiens
  source 1..20: mol_type = genomic RNA
gatgcgccaaacatcctgca

SEQ ID NO: 24 - RNA, 20 nt, Homo sapiens
  source 1..20: mol_type = genomic RNA
atctggcagtattgggcatt

SEQ ID NO: 25 - RNA, 20 nt, Homo sapiens
  source 1..20: mol_type = genomic RNA
gcgtggcatatgaaaaaaac

SEQ ID NO: 26 - RNA, 20 nt, Homo sapiens
  source 1..20: mol_type = genomic RNA
tataaaggagttgatatgag

SEQ ID NO: 27 - RNA, 20 nt, Homo sapiens
  source 1..20: mol_type = genomic RNA
acaccttgaattgtactcac

SEQ ID NO: 28 - RNA, 20 nt, Homo sapiens
  source 1..20: mol_type = genomic RNA
tgaggtgcacattccaccca

SEQ ID NO: 29 - RNA, 20 nt, Homo sapiens
  source 1..20: mol_type = genomic RNA
ctggcagtattgggcatttg

SEQ ID NO: 30 - RNA, 20 nt, Homo sapiens
  source 1..20: mol_type = genomic RNA
aaaacgccttcttcagaggt

SEQ ID NO: 31 - RNA, 20 nt, Homo sapiens
  source 1..20: mol_type = genomic RNA
tgaatagcaaacaccttggg

SEQ ID NO: 32 - RNA, 20 nt, Homo sapiens
  source 1..20: mol_type = genomic RNA
agtcaattttaatgtgtcta

SEQ ID NO: 33 - RNA, 20 nt, Homo sapiens
  source 1..20: mol_type = genomic RNA
gtgttgaagaatgccaaaaa

SEQ ID NO: 34 - RNA, 20 nt, Homo sapiens
  source 1..20: mol_type = genomic RNA
tgccttgtgaaatgtttgcg

SEQ ID NO: 35 - RNA, 20 nt, Homo sapiens
  source 1..20: mol_type = genomic RNA
gcatcttgcgttctcagatg

SEQ ID NO: 36 - RNA, 20 nt, Homo sapiens
  source 1..20: mol_type = genomic RNA
tctcagatgtggatgttgcc

SEQ ID NO: 37 - RNA, 20 nt, Homo sapiens
  source 1..20: mol_type = genomic RNA
ctccagatgcttttgtgtgt

SEQ ID NO: 38 - RNA, 20 nt, Homo sapiens
  source 1..20: mol_type = genomic RNA
tattatcaaatcacattacc

SEQ ID NO: 39 - RNA, 20 nt, Homo sapiens
  source 1..20: mol_type = genomic RNA
ccagatatggtgttttcttg

SEQ ID NO: 40 - RNA, 20 nt, Homo sapiens
  source 1..20: mol_type = genomic RNA
aagttcttttgcaggttaaa

SEQ ID NO: 41 - RNA, 20 nt, Homo sapiens
  source 1..20: mol_type = genomic RNA
tttactcccagaagactgta

SEQ ID NO: 42 - RNA, 20 nt, Homo sapiens
  source 1..20: mol_type = genomic RNA
tgccattctaaaatttaccc

SEQ ID NO: 43 - RNA, 20 nt, Homo sapiens
  source 1..20: mol_type = genomic RNA
tcatctttgtgcaagtctct

SEQ ID NO: 44 - RNA, 20 nt, Homo sapiens
  source 1..20: mol_type = genomic RNA
tctcctccaaagtcaactcc

SEQ ID NO: 45 - RNA, 20 nt, Homo sapiens
  source 1..20: mol_type = genomic RNA
ggaggaacaaactcttcttg

SEQ ID NO: 46 - RNA, 20 nt, Homo sapiens
  source 1..20: mol_type = genomic RNA
aggtgaagctgacagctcag

SEQ ID NO: 47 - RNA, 20 nt, Homo sapiens
  source 1..20: mol_type = genomic RNA
ccatccggttacccaacagt

SEQ ID NO: 48 - RNA, 20 nt, Homo sapiens
  source 1..20: mol_type = genomic RNA
tataccaactgttgggtaac

SEQ ID NO: 49 - RNA, 20 nt, Homo sapiens
  source 1..20: mol_type = genomic RNA
gcacaatttataccaactgt

SEQ ID NO: 50 - RNA, 20 nt, Homo sapiens
  source 1..20: mol_type = genomic RNA
aaccggatggggcttctcga

SEQ ID NO: 51 - RNA, 20 nt, Homo sapiens
  source 1..20: mol_type = genomic RNA
caactgttgggtaaccggat

SEQ ID NO: 52 - RNA, 20 nt, Homo sapiens
  source 1..20: mol_type = genomic RNA
cacaatttataccaactgtt

SEQ ID NO: 53 - RNA, 20 nt, Homo sapiens
  source 1..20: mol_type = genomic RNA
ccaactgttgggtaaccgga

SEQ ID NO: 54 - RNA, 20 nt, Homo sapiens
  source 1..20: mol_type = genomic RNA
ctccttcgagaagccccatc

SEQ ID NO: 55 - RNA, 20 nt, Homo sapiens
  source 1..20: mol_type = genomic RNA
aactgttgggtaaccggatg

SEQ ID NO: 56 - RNA, 20 nt, Homo sapiens
  source 1..20: mol_type = genomic RNA
ccaatatgcctaccttccaa

SEQ ID NO: 57 - RNA, 20 nt, Homo sapiens
  source 1..20: mol_type = genomic RNA
gtgcttgtgtcacctttgga

SEQ ID NO: 58 - RNA, 20 nt, Homo sapiens
  source 1..20: mol_type = genomic RNA
ttgtgtcacctttggaaggt

SEQ ID NO: 59 - RNA, 20 nt, Homo sapiens
  source 1..20: mol_type = genomic RNA
aattgtgcttgtgtcacctt

SEQ ID NO: 60 - RNA, 20 nt, Homo sapiens
  source 1..20: mol_type = genomic RNA
aaggtaggcatattggtttt

SEQ ID NO: 61 - RNA, 20 nt, Homo sapiens
  source 1..20: mol_type = genomic RNA
acccaacggatggtctgtgc

SEQ ID NO: 62 - RNA, 20 nt, Homo sapiens
  source 1..20: mol_type = genomic RNA
agccagcacagaccatccgt

SEQ ID NO: 63 - RNA, 20 nt, Homo sapiens
  source 1..20: mol_type = genomic RNA
ttataaaataacccaacgga

SEQ ID NO: 64 - RNA, 20 nt, Homo sapiens
  source 1..20: mol_type = genomic RNA
ctgtgctggctataaagaag

SEQ ID NO: 65 - RNA, 20 nt, Homo sapiens
  source 1..20: mol_type = genomic RNA
cattcttcatttgttaccaa

SEQ ID NO: 66 - RNA, 20 nt, Homo sapiens
  source 1..20: mol_type = genomic RNA
tataatcttgatatcttttc

SEQ ID NO: 67 - RNA, 20 nt, Homo sapiens
  source 1..20: mol_type = genomic RNA
gccagcacagaccatccgtt

SEQ ID NO: 68 - RNA, 20 nt, Homo sapiens
  source 1..20: mol_type = genomic RNA
gtctgtgctggctataaaga

SEQ ID NO: 69 - RNA, 20 nt, Homo sapiens
  source 1..20: mol_type = genomic RNA
tctgtgctggctataaagaa

SEQ ID NO: 70 - RNA, 20 nt, Homo sapiens
  source 1..20: mol_type = genomic RNA
gtccatgtactcagcgactt

SEQ ID NO: 71 - RNA, 20 nt, Homo sapiens
  source 1..20: mol_type = genomic RNA
caccaaagtcgctgagtaca

SEQ ID NO: 72 - RNA, 20 nt, Homo sapiens
  source 1..20: mol_type = genomic RNA
acacaatggaatgtggcgtt

SEQ ID NO: 73 - RNA, 20 nt, Homo sapiens
  source 1..20: mol_type = genomic RNA
tttggtgggcatcaccagct

SEQ ID NO: 74 - RNA, 20 nt, Homo sapiens
  source 1..20: mol_type = genomic RNA
ctctggactgcttctcatgc

SEQ ID NO: 75 - RNA, 20 nt, Homo sapiens
  source 1..20: mol_type = genomic RNA
aagtcgctgagtacatggac

SEQ ID NO: 76 - RNA, 20 nt, Homo sapiens
  source 1..20: mol_type = genomic RNA
gggtgaaggctgtgcccgca

SEQ ID NO: 77 - RNA, 20 nt, Homo sapiens
  source 1..20: mol_type = genomic RNA
aatggaatgtggcgtttggt

SEQ ID NO: 78 - RNA, 20 nt, Homo sapiens
  source 1..20: mol_type = genomic RNA
tccattgtgtttgcaaacta

SEQ ID NO: 79 - RNA, 20 nt, Homo sapiens
  source 1..20: mol_type = genomic RNA
gtttggtgggcatcaccagc

SEQ ID NO: 80 - RNA, 20 nt, Homo sapiens
  source 1..20: mol_type = genomic RNA
tttgcaaacacaatggaatg

SEQ ID NO: 81 - RNA, 20 nt, Homo sapiens
  source 1..20: mol_type = genomic RNA
gacaccaggttgctccctgc

SEQ ID NO: 82 - RNA, 20 nt, Homo sapiens
  source 1..20: mol_type = genomic RNA
actgtgactcagggagattc

SEQ ID NO: 83 - RNA, 20 nt, Homo sapiens
  source 1..20: mol_type = genomic RNA
tgtgcccgcagggagcaacc

SEQ ID NO: 84 - RNA, 20 nt, Homo sapiens
  source 1..20: mol_type = genomic RNA
ccattgtgtttgcaaactaa

SEQ ID NO: 85 - RNA, 20 nt, Homo sapiens
  source 1..20: mol_type = genomic RNA
ggggtgaaggctgtgcccgc

SEQ ID NO: 86 - RNA, 20 nt, Homo sapiens
  source 1..20: mol_type = genomic RNA
gcgactttggtgtagacacc

SEQ ID NO: 87 - RNA, 20 nt, Homo sapiens
  source 1..20: mol_type = genomic RNA
cccttagtttgcaaacacaa

SEQ ID NO: 88 - RNA, 20 nt, Homo sapiens
  source 1..20: mol_type = genomic RNA
caatggaatgtggcgtttgg

SEQ ID NO: 89 - RNA, 20 nt, Homo sapiens
  source 1..20: mol_type = genomic RNA
aactgaatagcaaacacctt

SEQ ID NO: 90 - RNA, 20 nt, Homo sapiens
  source 1..20: mol_type = genomic RNA
acaattaccaatttctgaaa

SEQ ID NO: 91 - RNA, 20 nt, Homo sapiens
  source 1..20: mol_type = genomic RNA
tacaattaccaatttctgaa

SEQ ID NO: 92 - RNA, 20 nt, Homo sapiens
  source 1..20: mol_type = genomic RNA
ggtgttttcttgaggagtag

SEQ ID NO: 93 - RNA, 20 nt, Homo sapiens
  source 1..20: mol_type = genomic RNA
cgggtaaattttagaatggc

SEQ ID NO: 94 - RNA, 20 nt, Homo sapiens
  source 1..20: mol_type = genomic RNA
ctcccgggtaaattttagaa

SEQ ID NO: 95 - RNA, 20 nt, Homo sapiens
  source 1..20: mol_type = genomic RNA
tatgggacacaagggagctc

SEQ ID NO: 96 - RNA, 20 nt, Homo sapiens
  source 1..20: mol_type = genomic RNA
ttggaggaacaaactcttct

SEQ ID NO: 97 - RNA, 20 nt, Homo sapiens
  source 1..20: mol_type = genomic RNA
tggaggaacaaactcttctt

SEQ ID NO: 98 - RNA, 20 nt, Homo sapiens
  source 1..20: mol_type = genomic RNA
caaactcttcttggggagag

SEQ ID NO: 99 - RNA, 20 nt, Homo sapiens
  source 1..20: mol_type = genomic RNA
ctatgagtgaccctccacac

SEQ ID NO: 100 - RNA, 20 nt, Homo sapiens
  source 1..20: mol_type = genomic RNA
ctgtgtggagggtcactcat

SEQ ID NO: 101 - RNA, 20 nt, Homo sapiens
  source 1..20: mol_type = genomic RNA
ggtcactcataggacaccag

SEQ ID NO: 102 - RNA, 20 nt, Homo sapiens
  source 1..20: mol_type = genomic RNA
gtcactcataggacaccagt

SEQ ID NO: 103 - RNA, 20 nt, Homo sapiens
  source 1..20: mol_type = genomic RNA
actgctgcccactgctttga

SEQ ID NO: 104 - RNA, 20 nt, Homo sapiens
  source 1..20: mol_type = genomic RNA
acacttacccatcaaagcag

SEQ ID NO: 105 - RNA, 20 nt, Homo sapiens
  source 1..20: mol_type = genomic RNA
aggaacacctaccgctataa

SEQ ID NO: 106 - RNA, 20 nt, Homo sapiens
  source 1..20: mol_type = genomic RNA
ctccgggactgtactttaat

SEQ ID NO: 107 - RNA, 20 nt, Homo sapiens
  source 1..20: mol_type = genomic RNA
gtcccatacgcaatcctagt

SEQ ID NO: 108 - RNA, 20 nt, Homo sapiens
  source 1..20: mol_type = genomic RNA
ctcagcacctttatagcggt

SEQ ID NO: 109 - RNA, 20 nt, Homo sapiens
  source 1..20: mol_type = genomic RNA
tatagcggtaggtgttcctc

SEQ ID NO: 110 - RNA, 20 nt, Homo sapiens
  source 1..20: mol_type = genomic RNA
ctattaaagtacagtcccgg

SEQ ID NO: 111 - RNA, 20 nt, Homo sapiens
  source 1..20: mol_type = genomic RNA
gtgctgagtaacgtggaatc

SEQ ID NO: 112 - RNA, 20 nt, Homo sapiens
  source 1..20: mol_type = genomic RNA
tataaaggtgctgagtaacg

SEQ ID NO: 113 - RNA, 20 nt, Homo sapiens
  source 1..20: mol_type = genomic RNA
tctccaactaggattgcgta

SEQ ID NO: 114 - RNA, 20 nt, Homo sapiens
  source 1..20: mol_type = genomic RNA
atagcggtaggtgttcctcc

SEQ ID NO: 115 - RNA, 20 nt, Homo sapiens
  source 1..20: mol_type = genomic RNA
ctgccaaaagtacatcgaac

SEQ ID NO: 116 - RNA, 20 nt, Homo sapiens
  source 1..20: mol_type = genomic RNA
accaatttctgaaagggcac

SEQ ID NO: 117 - RNA, 20 nt, Homo sapiens
  source 1..20: mol_type = genomic RNA
gtgtttcttaagattatcta

SEQ ID NO: 118 - RNA, 20 nt, Homo sapiens
  source 1..20: mol_type = genomic RNA
ccaatttctgaaagggcaca

SEQ ID NO: 119 - RNA, 20 nt, Homo sapiens
  source 1..20: mol_type = genomic RNA
ttcttaagattatctatgga

SEQ ID NO: 120 - RNA, 20 nt, Homo sapiens
  source 1..20: mol_type = genomic RNA
ctgttcgatgtacttttggc

SEQ ID NO: 121 - RNA, 20 nt, Homo sapiens
  source 1..20: mol_type = genomic RNA
tgttcgatgtacttttggca

SEQ ID NO: 122 - RNA, 20 nt, Homo sapiens
  source 1..20: mol_type = genomic RNA
ggtggaatgtgcacctcatc

SEQ ID NO: 123 - RNA, 20 nt, Homo sapiens
  source 1..20: mol_type = genomic RNA
gtccgacacacaaaagcatc

SEQ ID NO: 124 - RNA, 20 nt, Homo sapiens
  source 1..20: mol_type = genomic RNA
aaactggcagcgaatgttac

SEQ ID NO: 125 - RNA, 20 nt, Homo sapiens
  source 1..20: mol_type = genomic RNA
tgccacgcaaacatttcaca

SEQ ID NO: 126 - RNA, 20 nt, Homo sapiens
  source 1..20: mol_type = genomic RNA
gcacctgttcgatgtacttt

SEQ ID NO: 127 - RNA, 20 nt, Homo sapiens
  source 1..20: mol_type = genomic RNA
agatgcgccaaacatcctgc

SEQ ID NO: 128 - RNA, 20 nt, Homo sapiens
  source 1..20: mol_type = genomic RNA
gcacctcatctggcagtatt

SEQ ID NO: 129 - RNA, 20 nt, Homo sapiens
  source 1..20: mol_type = genomic RNA
catctgagaacgcaagatgc

SEQ ID NO: 130 - RNA, 20 nt, Homo sapiens
  source 1..20: mol_type = genomic RNA
atgcccaatactgccagatg

SEQ ID NO: 131 - RNA, 20 nt, Homo sapiens
  source 1..20: mol_type = genomic RNA
tgcacctcatctggcagtat

SEQ ID NO: 132 - RNA, 20 nt, Homo sapiens
  source 1..20: mol_type = genomic RNA
atgtcattgattgaacttgc

SEQ ID NO: 133 - RNA, 20 nt, Homo sapiens
  source 1..20: mol_type = genomic RNA
acaagcacacgcattgttgg

SEQ ID NO: 134 - RNA, 20 nt, Homo sapiens
  source 1..20: mol_type = genomic RNA
tatcgccttgataaaactcc

SEQ ID NO: 135 - RNA, 20 nt, Homo sapiens
  source 1..20: mol_type = genomic RNA
cctcaagaaaacaccatatc

SEQ ID NO: 136 - RNA, 20 nt, Homo sapiens
  source 1..20: mol_type = genomic RNA
aaacgccttcttcagaggtg

SEQ ID NO: 137 - RNA, 20 nt, Homo sapiens
  source 1..20: mol_type = genomic RNA
aaaacaagcacacgcattgt

SEQ ID NO: 138 - RNA, 20 nt, Homo sapiens
  source 1..20: mol_type = genomic RNA
catcgaacaggtgcagtttc

SEQ ID NO: 139 - RNA, 20 nt, Homo sapiens
  source 1..20: mol_type = genomic RNA
ggcttcccctgcaggatgtt

SEQ ID NO: 140 - RNA, 20 nt, Homo sapiens
  source 1..20: mol_type = genomic RNA
ttgatgaccacattgcttca

SEQ ID NO: 141 - RNA, 20 nt, Homo sapiens
  source 1..20: mol_type = genomic RNA
aggagcctggagttttatca

SEQ ID NO: 142 - RNA, 20 nt, Homo sapiens
  source 1..20: mol_type = genomic RNA
tgccatcgagacatttataa

SEQ ID NO: 143 - RNA, 20 nt, Homo sapiens
  source 1..20: mol_type = genomic RNA
agcaagttcaatcaatgaca

SEQ ID NO: 144 - RNA, 20 nt, Homo sapiens
  source 1..20: mol_type = genomic RNA
ggacattccttgaagcaatg

SEQ ID NO: 145 - RNA, 20 nt, Homo sapiens
  source 1..20: mol_type = genomic RNA
gttggggtgataggtgcaga

SEQ ID NO: 146 - RNA, 20 nt, Homo sapiens
  source 1..20: mol_type = genomic RNA
gaaaacgccttcttcagagg

SEQ ID NO: 147 - RNA, 20 nt, Homo sapiens
  source 1..20: mol_type = genomic RNA
tatgaaaacgccttcttcag

SEQ ID NO: 148 - RNA, 20 nt, Homo sapiens
  source 1..20: mol_type = genomic RNA
ctcagatgtggatgttgcca

SEQ ID NO: 149 - RNA, 20 nt, Homo sapiens
  source 1..20: mol_type = genomic RNA
ctctcctaggcttcccctgc

SEQ ID NO: 150-166 - skipped (17 entries)

SEQ ID NO: 167 - RNA, 22 nt, synthetic construct
  misc_feature 1..22: note = Synthetic
  source 1..22: mol_type = other RNA
gttttagagctatgctgttttg

SEQ ID NO: 168 - RNA, 80 nt, synthetic construct
  misc_feature 1..80: note = Synthetic
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  source 1..80: mol_type = other RNA
gttttagagctagaaatagcaagttaaaataaggctagtccgttatcaacttgaaaaagtggcaccgagtcggtgctttt

SEQ ID NO: 169 - RNA, 72 nt, synthetic construct
  misc_feature 1..72: note = Synthetic
  modified_base 69: mod_base = OTHER; note = 2'-O-methyl modification and phosphorothioate bond
  modified_base 70: mod_base = OTHER; note = 2'-O-methyl modification and phosphorothioate bond
  modified_base 71: mod_base = OTHER; note = 2'-O-methyl modification and phosphorothioate bond
  source 1..72: mol_type = other RNA
gttttagagctagaaatagcaagttaaaataaggctagtccgttatcaacttggcaccgagtcggtgctttt

SEQ ID NO: 170 - RNA, 72 nt, synthetic construct; identical to SEQ ID NO: 169
  misc_feature 1..72: note = Synthetic
  source 1..72: mol_type = other RNA

SEQ ID NO: 171 - RNA, 80 nt, synthetic construct; identical to SEQ ID NO: 168
  misc_feature 1..80: note = Synthetic
  source 1..80: mol_type = other RNA

SEQ ID NO: 172 - RNA, 76 nt, synthetic construct
  misc_feature 1..76: note = Synthetic
  source 1..76: mol_type = other RNA
gttttagagctagaaatagcaagttaaaataaggctagtccgttatcaacttgaaaaagtggcaccgagtcggtgc

SEQ ID NO: 173 - RNA, 68 nt, synthetic construct
  misc_feature 1..68: note = Synthetic
  source 1..68: mol_type = other RNA
gttttagagctagaaatagcaagttaaaataaggctagtccgttatcaacttggcaccgagtcggtgc

SEQ ID NO: 174 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttatcaactaagcaccgagtcggtgc

SEQ ID NO: 175 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttatcaactcagcaccgagtcggtgc

SEQ ID NO: 176 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttatccacttggcaccgagtcggtgc

SEQ ID NO: 177 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaatacggctagtccgttatcaacttggcaccgagtcggtgc

SEQ ID NO: 178 - RNA, 70 nt, synthetic construct
  misc_feature 1..70: note = Synthetic
  modified_base 67: mod_base = OTHER; note = phosphorothioate bond
  modified_base 68: mod_base = OTHER; note = 2'-O-methyl modification and phosphorothioate bond
  modified_base 69: mod_base = OTHER; note = 2'-O-methyl modification and phosphorothioate bond
  modified_base 70: mod_base = OTHER; note = 2'-O-methyl modification
  source 1..70: mol_type = other RNA
gttttagagctagaaatagcaagttaaaataaggctagtccgttatcaagagctggcaccgagtcggtgc

SEQ ID NO: 179 - RNA, 70 nt, synthetic construct
  misc_feature 1..70: note = Synthetic
  modified_base 67: mod_base = OTHER; note = phosphorothioate bond
  modified_base 68: mod_base = OTHER; note = 2'-O-methyl modification and phosphorothioate bond
  modified_base 69: mod_base = OTHER; note = 2'-O-methyl modification and phosphorothioate bond
  modified_base 70: mod_base = OTHER; note = 2'-O-methyl modification
  source 1..70: mol_type = other RNA
gttttagagctagaaatagcaagttaaaataaggctagtccgttatcaagaaatggcaccgagtcggtgc

SEQ ID NO: 180 - RNA, 70 nt, synthetic construct
  misc_feature 1..70: note = Synthetic
  modified_base 67: mod_base = OTHER; note = phosphorothioate bond
  modified_base 68: mod_base = OTHER; note = 2'-O-methyl modification and phosphorothioate bond
  modified_base 69: mod_base = OTHER; note = 2'-O-methyl modification and phosphorothioate bond
  modified_base 70: mod_base = OTHER; note = 2'-O-methyl modification
  source 1..70: mol_type = other RNA
gttttagagctagaaatagcaagttaaaataaggctagtccgttatcacgaaagggcaccgagtcggtgc

SEQ ID NO: 181 - RNA, 69 nt, synthetic construct
  misc_feature 1..69: note = Synthetic
  modified_base 66: mod_base = OTHER; note = phosphorothioate bond
  modified_base 67: mod_base = OTHER; note = 2'-O-methyl modification and phosphorothioate bond
  modified_base 68: mod_base = OTHER; note = 2'-O-methyl modification and phosphorothioate bond
  modified_base 69: mod_base = OTHER; note = 2'-O-methyl modification
  source 1..69: mol_type = other RNA
gttttagagctagaaatagcaagttaaaataaggctagtccgttatcaaaaatggcaccgagtcggtgc

SEQ ID NO: 182 - RNA, 69 nt, synthetic construct
  misc_feature 1..69: note = Synthetic
  modified_base 66: mod_base = OTHER; note = phosphorothioate bond
  modified_base 67: mod_base = OTHER; note = 2'-O-methyl modification and phosphorothioate bond
  modified_base 68: mod_base = OTHER; note = 2'-O-methyl modification and phosphorothioate bond
  modified_base 69: mod_base = OTHER; note = 2'-O-methyl modification
  source 1..69: mol_type = other RNA
gttttagagctagaaatagcaagttaaaataaggctagtccgttatcaaaagtggcaccgagtcggtgc

SEQ ID NO: 183 - RNA, 69 nt, synthetic construct
  misc_feature 1..69: note = Synthetic
  modified_base 66: mod_base = OTHER; note = phosphorothioate bond
  modified_base 67: mod_base = OTHER; note = 2'-O-methyl modification and phosphorothioate bond
  modified_base 68: mod_base = OTHER; note = 2'-O-methyl modification and phosphorothioate bond
  modified_base 69: mod_base = OTHER; note = 2'-O-methyl modification
  source 1..69: mol_type = other RNA
gttttagagctagaaatagcaagttaaaataaggctagtccgttatcaacagtggcaccgagtcggtgc

SEQ ID NO: 184 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttatcacaagggcaccgagtcggtgc

SEQ ID NO: 185 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttatcaaaatggcaccgagtcggtgc

SEQ ID NO: 186 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagctagaaatagcaagttaaaataaggctagtccgttatcaaaggcaccgagtcggtgc

SEQ ID NO: 187 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagctagaaatagcaagttaaaataaggctagtccgttatcaagggcaccgagtcggtgc

SEQ ID NO: 188 - RNA, 64 nt, synthetic construct
  misc_feature 1..64: note = Synthetic
  modified_base 61: mod_base = OTHER; note = phosphorothioate bond
  modified_base 62: mod_base = OTHER; note = 2'-O-methyl modification and phosphorothioate bond
  modified_base 63: mod_base = OTHER; note = 2'-O-methyl modification and phosphorothioate bond
  modified_base 64: mod_base = OTHER; note = 2'-O-methyl modification
  source 1..64: mol_type = other RNA
gttttagagctagaaatagcaagttaaaataaggctagtccgttatcaggcaccgagtcggtgc

SEQ ID NO: 189 - RNA, 67 nt, synthetic construct
  misc_feature 1..67: note = Synthetic
  modified_base 64: mod_base = OTHER; note = phosphorothioate bond
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification
  source 1..67: mol_type = other RNA
gttttagagctagaatagcaagttaaaataaggctagtccgttatcaacttggcaccgagtcggtgc

SEQ ID NO: 190 - RNA, 67 nt, synthetic construct
  misc_feature 1..67: note = Synthetic
  modified_base 64: mod_base = OTHER; note = phosphorothioate bond
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification
  source 1..67: mol_type = other RNA
gttttagagcgcaaagcgcaagttaaaataaggctagtccgttatcaacttggcaccgagtcggtgc

SEQ ID NO: 191 - RNA, 67 nt, synthetic construct
  misc_feature 1..67: note = Synthetic
  modified_base 64: mod_base = OTHER; note = phosphorothioate bond
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification
  source 1..67: mol_type = other RNA
gttttagagcgcgaagcgcaagttaaaataaggctagtccgttatcaacttggcaccgagtcggtgc

SEQ ID NO: 192 - RNA, 67 nt, synthetic construct
  misc_feature 1..67: note = Synthetic
  modified_base 64: mod_base = OTHER; note = phosphorothioate bond
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification
  source 1..67: mol_type = other RNA
gttttagagcggaaacgcaagttaaaataaggctagtccgttatcaacttggcaccgagtcggtgct

SEQ ID NO: 193 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagcggaaacgcaagttaaaataaggctagtccgttatcaacttggcaccgagtcggtgc

SEQ ID NO: 194 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagccgaaaggcaagttaaaataaggctagtccgttatcaacttggcaccgagtcggtgc

SEQ ID NO: 195 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagctgaaaagcaagttaaaataaggctagtccgttatcaacttggcaccgagtcggtgc

SEQ ID NO: 196 - RNA, 64 nt, synthetic construct
  misc_feature 1..64: note = Synthetic
  modified_base 61: mod_base = OTHER; note = phosphorothioate bond
  modified_base 62: mod_base = OTHER; note = 2'-O-methyl modification and phosphorothioate bond
  modified_base 63: mod_base = OTHER; note = 2'-O-methyl modification and phosphorothioate bond
  modified_base 64: mod_base = OTHER; note = 2'-O-methyl modification
  source 1..64: mol_type = other RNA
gttttagagcgaaagcaagttaaaataaggctagtccgttatcaacttggcaccgagtcggtgc

SEQ ID NO: 197 - RNA, 63 nt, synthetic construct
  misc_feature 1..63: note = Synthetic
  modified_base 60: mod_base = OTHER; note = phosphorothioate bond
  modified_base 61: mod_base = OTHER; note = 2'-O-methyl modification and phosphorothioate bond
  modified_base 62: mod_base = OTHER; note = 2'-O-methyl modification and phosphorothioate bond
  modified_base 63: mod_base = OTHER; note = 2'-O-methyl modification
  source 1..63: mol_type = other RNA
gttttagagcgaagcaagttaaaataaggctagtccgttatcaacttggcaccgagtcggtgc

SEQ ID NO: 198 - RNA, 63 nt, synthetic construct
  misc_feature 1..63: note = Synthetic
  modified_base 60: mod_base = OTHER; note = phosphorothioate bond
  modified_base 61: mod_base = OTHER; note = 2'-O-methyl modification and phosphorothioate bond
  modified_base 62: mod_base = OTHER; note = 2'-O-methyl modification and phosphorothioate bond
  modified_base 63: mod_base = OTHER; note = 2'-O-methyl modification
  source 1..63: mol_type = other RNA
gttttagagcaaagcaagttaaaataaggctagtccgttatcaacttggcaccgagtcggtgc

SEQ ID NO: 199 - RNA, 62 nt, synthetic construct
  misc_feature 1..62: note = Synthetic
  modified_base 59: mod_base = OTHER; note = phosphorothioate bond
  modified_base 60: mod_base = OTHER; note = 2'-O-methyl modification and phosphorothioate bond
  modified_base 61: mod_base = OTHER; note = 2'-O-methyl modification and phosphorothioate bond
  modified_base 62: mod_base = OTHER; note = 2'-O-methyl modification
  source 1..62: mol_type = other RNA
gttttagaggaaacaagttaaaataaggctagtccgttatcaacttggcaccgagtcggtgc

SEQ ID NO: 200 - skipped

SEQ ID NO: 201 - RNA, 105 nt, synthetic construct
  misc_feature 1..105: note = Synthetic
  misc_feature 1..25: note = n is a, c, g, or u
  source 1..105: mol_type = other RNA
nnnnnnnnnnnnnnnnnnnnnnnnngttttagagctagaaatagcaagttaaaataaggctagtccgttatcaacttgaaaaagtggcaccgagtcggtgctttt

SEQ ID NO: 202 - RNA, 62 nt, synthetic construct
  misc_feature 1..62: note = Synthetic
  modified_base 59: mod_base = OTHER; note = phosphorothioate bond
  modified_base 60: mod_base = OTHER; note = 2'-O-methyl modification and phosphorothioate bond
  modified_base 61: mod_base = OTHER; note = 2'-O-methyl modification and phosphorothioate bond
  modified_base 62: mod_base = OTHER; note = 2'-O-methyl modification
  source 1..62: mol_type = other RNA
gttttagagcaagcaagttaaaataaggctagtccgttatcaacttggcaccgagtcggtgc

SEQ ID NO: 203 - RNA, 62 nt, synthetic construct
  misc_feature 1..62: note = Synthetic
  modified_base 59: mod_base = OTHER; note = phosphorothioate bond
  modified_base 60: mod_base = OTHER; note = 2'-O-methyl modification and phosphorothioate bond
  modified_base 61: mod_base = OTHER; note = 2'-O-methyl modification and phosphorothioate bond
  modified_base 62: mod_base = OTHER; note = 2'-O-methyl modification
  source 1..62: mol_type = other RNA
gttttagagcgagcaagttaaaataaggctagtccgttatcaacttggcaccgagtcggtgc

SEQ ID NO: 204 - RNA, 60 nt, synthetic construct
  misc_feature 1..60: note = Synthetic
  modified_base 57: mod_base = OTHER; note = phosphorothioate bond
  modified_base 58: mod_base = OTHER; note = 2'-O-methyl modification and phosphorothioate bond
  modified_base 59: mod_base = OTHER; note = 2'-O-methyl modification and phosphorothioate bond
  modified_base 60: mod_base = OTHER; note = 2'-O-methyl modification
  source 1..60: mol_type = other RNA
gttttagagcgcaagttaaaataaggctagtccgttatcaacttggcaccgagtcggtgc

SEQ ID NO: 205 - RNA, 60 nt, synthetic construct
  misc_feature 1..60: note = Synthetic
  modified_base 57: mod_base = OTHER; note = phosphorothioate bond
  modified_base 58: mod_base = OTHER; note = 2'-O-methyl modification and phosphorothioate bond
  modified_base 59: mod_base = OTHER; note = 2'-O-methyl modification and phosphorothioate bond
  modified_base 60: mod_base = OTHER; note = 2'-O-methyl modification
  source 1..60: mol_type = other RNA
gttttagagaacaagttaaaataaggctagtccgttatcaacttggcaccgagtcggtgc

SEQ ID NO: 206 - RNA, 59 nt, synthetic construct
  misc_feature 1..59: note = Synthetic
  modified_base 56: mod_base = OTHER; note = phosphorothioate bond
  modified_base 57: mod_base = OTHER; note = 2'-O-methyl modification and phosphorothioate bond
  modified_base 58: mod_base = OTHER; note = 2'-O-methyl modification and phosphorothioate bond
  modified_base 59: mod_base = OTHER; note = 2'-O-methyl modification
  source 1..59: mol_type = other RNA
gttttagagacaagttaaaataaggctagtccgttatcaacttggcaccgagtcggtgc

SEQ ID NO: 207 - RNA, 58 nt, synthetic construct
  misc_feature 1..58: note = Synthetic
  modified_base 55: mod_base = OTHER; note = phosphorothioate bond
  modified_base 56: mod_base = OTHER; note = 2'-O-methyl modification and phosphorothioate bond
  modified_base 57: mod_base = OTHER; note = 2'-O-methyl modification and phosphorothioate bond
  modified_base 58: mod_base = OTHER; note = 2'-O-methyl modification
  source 1..58: mol_type = other RNA
gttttagagcaagttaaaataaggctagtccgttatcaacttggcaccgagtcggtgc

SEQ ID NO: 208 - RNA, 58 nt, synthetic construct
  misc_feature 1..58: note = Synthetic
  modified_base 55: mod_base = OTHER; note = phosphorothioate bond
  modified_base 56: mod_base = OTHER; note = 2'-O-methyl modification and phosphorothioate bond
  modified_base 57: mod_base = OTHER; note = 2'-O-methyl modification and phosphorothioate bond
  modified_base 58: mod_base = OTHER; note = 2'-O-methyl modification
  source 1..58: mol_type = other RNA
gttttagaaaaagttaaaataaggctagtccgttatcaacttggcaccgagtcggtgc

SEQ ID NO: 209 - RNA, 57 nt, synthetic construct
  misc_feature 1..57: note = Synthetic
  modified_base 54: mod_base = OTHER; note = phosphorothioate bond
  modified_base 55: mod_base = OTHER; note = 2'-O-methyl modification and phosphorothioate bond
  modified_base 56: mod_base = OTHER; note = 2'-O-methyl modification and phosphorothioate bond
  modified_base 57: mod_base = OTHER; note = 2'-O-methyl modification
  source 1..57: mol_type = other RNA
gttttagaaaagttaaaataaggctagtccgttatcaacttggcaccgagtcggtgc

SEQ ID NO: 210 - RNA, 67 nt, synthetic construct
  misc_feature 1..67: note = Synthetic
  modified_base 64: mod_base = OTHER; note = phosphorothioate bond
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification
  source 1..67: mol_type = other RNA
gttttagagctagaaatagcaagttaaaataaggctagtccgttatcaacttggcaccgagtcggtg

SEQ ID NO: 211 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagctagaaatagcaagttaaaataaggctagtccgttatcaacttggcaccgagtcggt

SEQ ID NO: 212 - RNA, 65 nt, synthetic construct
  misc_feature 1..65: note = Synthetic
  modified_base 62: mod_base = OTHER; note = phosphorothioate bond
  modified_base 63: mod_base = OTHER; note = 2'-O-methyl modification and phosphorothioate bond
  modified_base 64: mod_base = OTHER; note = 2'-O-methyl modification and phosphorothioate bond
  modified_base 65: mod_base = OTHER; note = 2'-O-methyl modification
  source 1..65: mol_type = other RNA
gttttagagctagaaatagcaagttaaaataaggctagtccgttatcaacttggcaccgagtcgg

SEQ ID NO: 213 - RNA, 64 nt, synthetic construct
  misc_feature 1..64: note = Synthetic
  modified_base 61: mod_base = OTHER; note = phosphorothioate bond
  modified_base 62: mod_base = OTHER; note = 2'-O-methyl modification and phosphorothioate bond
  modified_base 63: mod_base = OTHER; note = 2'-O-methyl modification and phosphorothioate bond
  modified_base 64: mod_base = OTHER; note = 2'-O-methyl modification
  source 1..64: mol_type = other RNA
gttttagagctagaaatagcaagttaaaataaggctagtccgttatcaacttggcaccgagtcg

SEQ ID NO: 214 - RNA, 63 nt, synthetic construct
  misc_feature 1..63: note = Synthetic
  modified_base 60: mod_base = OTHER; note = phosphorothioate bond
  modified_base 61: mod_base = OTHER; note = 2'-O-methyl modification and phosphorothioate bond
  modified_base 62: mod_base = OTHER; note = 2'-O-methyl modification and phosphorothioate bond
  modified_base 63: mod_base = OTHER; note = 2'-O-methyl modification
  source 1..63: mol_type = other RNA
gttttagagctagaaatagcaagttaaaataaggctagtccgttatcaacttggcaccgagtc

SEQ ID NO: 215 - RNA, 62 nt, synthetic construct
  misc_feature 1..62: note = Synthetic
  modified_base 59: mod_base = OTHER; note = phosphorothioate bond
  modified_base 60: mod_base = OTHER; note = 2'-O-methyl modification and phosphorothioate bond
  modified_base 61: mod_base = OTHER; note = 2'-O-methyl modification and phosphorothioate bond
  modified_base 62: mod_base = OTHER; note = 2'-O-methyl modification
  source 1..62: mol_type = other RNA
gttttagagctagaaatagcaagttaaaataaggctagtccgttatcaacttggcaccgagt

SEQ ID NO: 216 - RNA, 62 nt, synthetic construct
  misc_feature 1..62: note = Synthetic
  modified_base 59: mod_base = OTHER; note = phosphorothioate bond
  modified_base 60: mod_base = OTHER; note = 2'-O-methyl modification and phosphorothioate bond
  modified_base 61: mod_base = OTHER; note = 2'-O-methyl modification and phosphorothioate bond
  modified_base 62: mod_base = OTHER; note = 2'-O-methyl modification
  source 1..62: mol_type = other RNA
gttttagagcgaaagcaagttaaaataaggctagtccgttatcactggcaccgagtcggtgc

SEQ ID NO: 217 - RNA, 60 nt, synthetic construct
  misc_feature 1..60: note = Synthetic
  modified_base 57: mod_base = OTHER; note = phosphorothioate bond
  modified_base 58: mod_base = OTHER; note = 2'-O-methyl modification and phosphorothioate bond
  modified_base 59: mod_base = OTHER; note = 2'-O-methyl modification and phosphorothioate bond
  modified_base 60: mod_base = OTHER; note = 2'-O-methyl modification
  source 1..60: mol_type = other RNA
gttttagagcgaaagcaagttaaaataaggctagtccgttatcaggcaccgagtcggtgc

SEQ ID NO: 218 - RNA, 60 nt, synthetic construct
  misc_feature 1..60: note = Synthetic
  modified_base 57: mod_base = OTHER; note = phosphorothioate bond
  modified_base 58: mod_base = OTHER; note = 2'-O-methyl modification and phosphorothioate bond
  modified_base 59: mod_base = OTHER; note = 2'-O-methyl modification and phosphorothioate bond
  modified_base 60: mod_base = OTHER; note = 2'-O-methyl modification
  source 1..60: mol_type = other RNA
gttttagagaaaaagttaaaataaggctagtccgttatcaacttggcaccgagtcggtgc

SEQ ID NO: 219 - RNA, 60 nt, synthetic construct
  misc_feature 1..60: note = Synthetic
  modified_base 57: mod_base = OTHER; note = phosphorothioate bond
  modified_base 58: mod_base = OTHER; note = 2'-O-methyl modification and phosphorothioate bond
  modified_base 59: mod_base = OTHER; note = 2'-O-methyl modification and phosphorothioate bond
  modified_base 60: mod_base = OTHER; note = 2'-O-methyl modification
  source 1..60: mol_type = other RNA
gttttagaggaaacaagttaaaataaggctagtccgttatcaatggcaccgagtcggtgc

SEQ ID NO: 220 - RNA, 58 nt, synthetic construct
  misc_feature 1..58: note = Synthetic
  modified_base 55: mod_base = OTHER; note = phosphorothioate bond
  modified_base 56: mod_base = OTHER; note = 2'-O-methyl modification and phosphorothioate bond
  modified_base 57: mod_base = OTHER; note = 2'-O-methyl modification and phosphorothioate bond
  modified_base 58: mod_base = OTHER; note = 2'-O-methyl modification
  source 1..58: mol_type = other RNA
gttttagagaaaaagttaaaataaggctagtccgttatcaatggcaccgagtcggtgc

SEQ ID NO: 221 - RNA, 60 nt, synthetic construct
  misc_feature 1..60: note = Synthetic
  modified_base 57: mod_base = OTHER; note = phosphorothioate bond
  modified_base 58: mod_base = OTHER; note = 2'-O-methyl modification and phosphorothioate bond
  modified_base 59: mod_base = OTHER; note = 2'-O-methyl modification and phosphorothioate bond
  modified_base 60: mod_base = OTHER; note = 2'-O-methyl modification
  source 1..60: mol_type = other RNA
gttttagaggaaacaagttaaaataaggctagtccgttatcactggcaccgagtcggtgc

SEQ ID NO: 222 - RNA, 56 nt, synthetic construct
  misc_feature 1..56: note = Synthetic
  modified_base 53: mod_base = OTHER; note = phosphorothioate bond
  modified_base 54: mod_base = OTHER; note = 2'-O-methyl modification and phosphorothioate bond
  modified_base 55: mod_base = OTHER; note = 2'-O-methyl modification and phosphorothioate bond
  modified_base 56: mod_base = OTHER; note = 2'-O-methyl modification
  source 1..56: mol_type = other RNA
gttttagagaaaaagttaaaataaggctagtccgttatcaggcaccgagtcggtgc

SEQ ID NO: 223 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagcgaaagcaagttaaaataaggctagtccgttatcaagctatggcaccgagtcggtgc

SEQ ID NO: 224 - RNA, 67 nt, synthetic construct
  misc_feature 1..67: note = Synthetic
  modified_base 64: mod_base = OTHER; note = phosphorothioate bond
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification
  source 1..67: mol_type = other RNA
gttttagagctagaaatagcaagttaaaataaggcagtccgttatcaacttggcaccgagtcggtgc

SEQ ID NO: 225 - RNA, 67 nt, synthetic construct
  misc_feature 1..67: note = Synthetic
  modified_base 64: mod_base = OTHER; note = phosphorothioate bond
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification
  source 1..67: mol_type = other RNA
gttttagagctagaaatagcaagttaaaataaggctgtccgttatcaacttggcaccgagtcggtgc

SEQ ID NO: 226 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagctagaaatagcaagttaaaataaggcgtccgttatcaacttggcaccgagtcggtgc

SEQ ID NO: 227 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagctagaaatagcaagttaaaataaggtatccgttatcaacttggcaccgagtcggtgc

SEQ ID NO: 228 - RNA, 65 nt, synthetic construct
  misc_feature 1..65: note = Synthetic
  modified_base 62: mod_base = OTHER; note = phosphorothioate bond
  modified_base 63: mod_base = OTHER; note = 2'-O-methyl modification and phosphorothioate bond
  modified_base 64: mod_base = OTHER; note = 2'-O-methyl modification and phosphorothioate bond
  modified_base 65: mod_base = OTHER; note = 2'-O-methyl modification
  source 1..65: mol_type = other RNA
gttttagagctagaaatagcaagttaaaataaggttccgttatcaacttggcaccgagtcggtgc

SEQ ID NO: 229 - RNA, 65 nt, synthetic construct
  misc_feature 1..65: note = Synthetic
  modified_base 62: mod_base = OTHER; note = phosphorothioate bond
  modified_base 63: mod_base = OTHER; note = 2'-O-methyl modification and phosphorothioate bond
  modified_base 64: mod_base = OTHER; note = 2'-O-methyl modification and phosphorothioate bond
  modified_base 65: mod_base = OTHER; note = 2'-O-methyl modification
  source 1..65: mol_type = other RNA
gttttagagctagaaatagcaagttaaaataaggatccgttatcaacttggcaccgagtcggtgc

SEQ ID NO: 230 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttcgagctagaaatagcaagtgaaaataaggctagtccgttatcaacttggcaccgagtcggtgc

SEQ ID NO: 231 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gtttttgagctagaaatagcaagtaaaaataaggctagtccgttatcaacttggcaccgagtcggtgc

SEQ ID NO: 232 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagcgagaaatcgcaagttaaaataaggctagtccgttatcaacttggcaccgagtcggtgc

SEQ ID NO: 233 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcgagttaaaataaggctagtccgttatcaacttggcaccgagtcggtgc

SEQ ID NO: 234 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagccggttaaaataaggctagtccgttatcaacttggcaccgagtcggtgc

SEQ ID NO: 235 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaatgaggctagtccgttatcaacttggcaccgagtcggtgc

SEQ ID NO: 236 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctggtccgttatcaacttggcaccgagtcggtgc

SEQ ID NO: 237 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctcgtccgttatcaacttggcaccgagtcggtgc

SEQ ID NO: 238 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggcttgtccgttatcaacttggcaccgagtcggtgc

SEQ ID NO: 239 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttgtcaacttggcaccgagtcggtgc

SEQ ID NO: 240 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttctcaacttggcaccgagtcggtgc

SEQ ID NO: 241 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttttcaacttggcaccgagtcggtgc

SEQ ID NO: 242 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttatgaacttggcaccgagtcggtgc

SEQ ID NO: 243 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttatcaacttgggaccgagtcggtcc

SEQ ID NO: 244 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttagagctagaaatagcaagttaaaataaggctagtccgttatcaacttggaaccgagtcggttc

SEQ ID NO: 245 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gttttcgagcgagaaatcgcgagtgaaaatgaggctggtccgttgtgaacttggaaccgagtcggttc

SEQ ID NO: 246 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gtttttgagcgagaaatcgcaagtaaaaataaggctcgtccgttctgaacttggaaccgagtcggttc

SEQ ID NO: 247 - RNA, 68 nt, synthetic construct
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA
gtttcggagccggaaacggcgagtcgaaatgaggctggtccgttgtcggctcggaaccgagtcggttc

SEQ ID NO: 248 - RNA, 68 nt, synthetic construct; identical to SEQ ID NO: 173
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 249 - RNA, 68 nt, synthetic construct; identical to SEQ ID NO: 173
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 250 - RNA, 68 nt, synthetic construct; identical to SEQ ID NO: 173
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 251 - RNA, 68 nt, synthetic construct; identical to SEQ ID NO: 173
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 252 - RNA, 68 nt, synthetic construct; identical to SEQ ID NO: 173
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 253 - RNA, 68 nt, synthetic construct; identical to SEQ ID NO: 173
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 254 - RNA, 68 nt, synthetic construct; identical to SEQ ID NO: 173
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 255 - RNA, 68 nt, synthetic construct; identical to SEQ ID NO: 173
  misc_feature 1..68: note = Synthetic
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 256 - RNA, 70 nt, synthetic construct; identical to SEQ ID NO: 180
  misc_feature 1..70: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 67: mod_base = OTHER; note = phosphorothioate bond
  modified_base 68: mod_base = OTHER; note = 2'-O-methyl modification and phosphorothioate bond
  modified_base 69: mod_base = OTHER; note = 2'-O-methyl modification and phosphorothioate bond
  modified_base 70: mod_base = OTHER; note = 2'-O-methyl modification
  source 1..70: mol_type = other RNA

SEQ ID NO: 257 - RNA, 69 nt, synthetic construct; identical to SEQ ID NO: 181
  misc_feature 1..69: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 66: mod_base = OTHER; note = phosphorothioate bond
  modified_base 67: mod_base = OTHER; note = 2'-O-methyl modification and phosphorothioate bond
  modified_base 68: mod_base = OTHER; note = 2'-O-methyl modification and phosphorothioate bond
  modified_base 69: mod_base = OTHER; note = 2'-O-methyl modification
  source 1..69: mol_type = other RNA

SEQ ID NO: 258 - RNA, 68 nt, synthetic construct; identical to SEQ ID NO: 184
  misc_feature 1..68: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 259 - RNA, 68 nt, synthetic construct; identical to SEQ ID NO: 185
  misc_feature 1..68: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 260 - RNA, 67 nt, synthetic construct
  misc_feature 1..67: note = Synthetic
  modified_base 64: mod_base = OTHER; note = phosphorothioate bond
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification
  source 1..67: mol_type = other RNA
gttttagagcgcgaagcgcaagttaaaataaggctagtccgttatcaaaatggcaccgagtcggtgc

SEQ ID NO: 261 - RNA, 66 nt, synthetic construct
  misc_feature 1..66: note = Synthetic
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagctgaaaagcaagttaaaataaggctagtccgttatcaaaatggcaccgagtcggtgc

SEQ ID NO: 262 - RNA, 64 nt, synthetic construct
  misc_feature 1..64: note = Synthetic
  modified_base 61: mod_base = OTHER; note = phosphorothioate bond
  modified_base 62: mod_base = OTHER; note = 2'-O-methyl modification and phosphorothioate bond
  modified_base 63: mod_base = OTHER; note = 2'-O-methyl modification and phosphorothioate bond
  modified_base 64: mod_base = OTHER; note = 2'-O-methyl modification
  source 1..64: mol_type = other RNA
gttttagagcgaaagcaagttaaaataaggctagtccgttatcaaaatggcaccgagtcggtgc

SEQ ID NO: 263 - RNA, 63 nt, synthetic construct
  misc_feature 1..63: note = Synthetic
  modified_base 60: mod_base = OTHER; note = phosphorothioate bond
  modified_base 61: mod_base = OTHER; note = 2'-O-methyl modification and phosphorothioate bond
  modified_base 62: mod_base = OTHER; note = 2'-O-methyl modification and phosphorothioate bond
  modified_base 63: mod_base = OTHER; note = 2'-O-methyl modification
  source 1..63: mol_type = other RNA
gttttagagcaaagcaagttaaaataaggctagtccgttatcaaaatggcaccgagtcggtgc

SEQ ID NO: 264 - RNA, 64 nt, synthetic construct; identical to SEQ ID NO: 196
  misc_feature 1..64: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 61: mod_base = OTHER; note = phosphorothioate bond
  modified_base 62: mod_base = OTHER; note = 2'-O-methyl modification and phosphorothioate bond
  modified_base 63: mod_base = OTHER; note = 2'-O-methyl modification and phosphorothioate bond
  modified_base 64: mod_base = OTHER; note = 2'-O-methyl modification
  source 1..64: mol_type = other RNA

SEQ ID NO: 265 - RNA, 66 nt, synthetic construct
  misc_feature 1..66: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 63: mod_base = OTHER; note = phosphorothioate bond
  modified_base 64: mod_base = OTHER; note = 2'-O-methyl modification and phosphorothioate bond
  modified_base 65: mod_base = OTHER; note = 2'-O-methyl modification and phosphorothioate bond
  modified_base 66: mod_base = OTHER; note = 2'-O-methyl modification
  source 1..66: mol_type = other RNA
gttttagagcgaaagcaagttaaaataaggctagtccgttatcaagaaatggcaccgagtcggtgc

SEQ ID NO: 266 - RNA, 70 nt, synthetic construct; identical to SEQ ID NO: 180
  misc_feature 1..70: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification and phosphorothioate bond
  modified_base 68: mod_base = OTHER; note = 2'-O-methyl modification and phosphorothioate bond
  modified_base 69: mod_base = OTHER; note = 2'-O-methyl modification and phosphorothioate bond
  modified_base 70: mod_base = OTHER; note = 2'-O-methyl modification
  source 1..70: mol_type = other RNA

SEQ ID NO: 267 - RNA, 68 nt, synthetic construct; identical to SEQ ID NO: 185
  misc_feature 1..68: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 268 - RNA, 70 nt, synthetic construct; identical to SEQ ID NO: 180
  misc_feature 1..70: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification and phosphorothioate bond
  modified_base 68: mod_base = OTHER; note = 2'-O-methyl modification and phosphorothioate bond
  modified_base 69: mod_base = OTHER; note = 2'-O-methyl modification and phosphorothioate bond
  modified_base 70: mod_base = OTHER; note = 2'-O-methyl modification
  source 1..70: mol_type = other RNA

SEQ ID NO: 269 - RNA, 68 nt, synthetic construct; identical to SEQ ID NO: 185
  misc_feature 1..68: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification and phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 270-299 - skipped (30 entries)

SEQ ID NO: 300 - RNA, 100 nt, synthetic construct
  misc_feature 1..100: note = Synthetic
  modified_base 1: mod_base = OTHER; note = 2'-O-methyl modification and phosphorothioate bond
  modified_base 2: mod_base = OTHER; note = 2'-O-methyl modification and phosphorothioate bond
  modified_base 3: mod_base = OTHER; note = 2'-O-methyl modification and phosphorothioate bond
  modified_base 29: mod_base = OTHER; note = 2'-O-methyl modification
  modified_base 30: mod_base = OTHER; note = 2'-O-methyl modification
  modified_base 31: mod_base = OTHER; note = 2'-O-methyl modification
  modified_base 32: mod_base = OTHER; note = 2'-O-methyl modification
  modified_base 33: mod_base = OTHER; note = 2'-O-methyl modification
  modified_base 34: mod_base = OTHER; note = 2'-O-methyl modification
  modified_base 35: mod_base = OTHER; note = 2'-O-methyl modification
  modified_base 36: mod_base = OTHER; note = 2'-O-methyl modification
  modified_base 37: mod_base = OTHER; note = 2'-O-methyl modification
  modified_base 38: mod_base = OTHER; note = 2'-O-methyl modification
  modified_base 39: mod_base = OTHER; note = 2'-O-methyl modification
  modified_base 40: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification
  modified_base 78: mod_base = OTHER; note = 2'-O-methyl modification
  modified_base 79: mod_base = OTHER; note = 2'-O-methyl modification
  modified_base 80: mod_base = OTHER; note = 2'-O-methyl modification
  modified_base 81: mod_base = OTHER; note = 2'-O-methyl modification
  modified_base 82: mod_base = OTHER; note = 2'-O-methyl modification
  modified_base 83: mod_base = OTHER; note = 2'-O-methyl modification
  modified_base 84: mod_base = OTHER; note = 2'-O-methyl modification
  modified_base 85: mod_base = OTHER; note = 2'-O-methyl modification
  modified_base 86: mod_base = OTHER; note = 2'-O-methyl modification
  modified_base 87: mod_base = OTHER; note = 2'-O-methyl modification
  modified_base 88: mod_base = OTHER; note = 2'-O-methyl modification
  modified_base 89: mod_base = OTHER; note = 2'-O-methyl modification
  modified_base 90: mod_base = OTHER; note = 2'-O-methyl modification
  modified_base 91: mod_base = OTHER; note = 2'-O-methyl modification
  modified_base 92: mod_base = OTHER; note = 2'-O-methyl modification
  modified_base 93: mod_base = OTHER; note = 2'-O-methyl modification
  modified_base 94: mod_base = OTHER; note = 2'-O-methyl modification
  modified_base 95: mod_base = OTHER; note = 2'-O-methyl modification
  modified_base 96: mod_base = OTHER; note = 2'-O-methyl modification
  modified_base 97: mod_base = OTHER; note = 2'-O-methyl modification and phosphorothioate bond
  modified_base 98: mod_base = OTHER; note = 2'-O-methyl modification and phosphorothioate bond
  modified_base 99: mod_base = OTHER; note = 2'-O-methyl modification and phosphorothioate bond
  modified_base 100: mod_base = OTHER; note = 2'-O-methyl modification
  variation 1..20: note = n is any natural or non-natural nucleotide
  source 1..100: mol_type = other RNA
nnnnnnnnnnnnnnnnnnnngttttagagctagaaatagcaagttaaaataaggctagtccgttatcaacttgaaaaagtggcaccgagtcggtgctttt

SEQ ID NO: 301-309 - skipped (9 entries)

SEQ ID NO: 310 - RNA, 20 nt, Macaca fascicularis
  source 1..20: mol_type = genomic RNA
gcacctgctcgacgtacttt

SEQ ID NO: 311 - RNA, 20 nt, Macaca fascicularis
  source 1..20: mol_type = genomic RNA
aggaacgcctaccactataa

SEQ ID NO: 312 - RNA, 20 nt, Macaca fascicularis
  source 1..20: mol_type = genomic RNA
tgatggaaacgctcggatgc

SEQ ID NO: 313 - RNA, 20 nt, Macaca fascicularis
  source 1..20: mol_type = genomic RNA
atagtggtaggcgttcctcc

SEQ ID NO: 314 - RNA, 20 nt, Macaca fascicularis
  source 1..20: mol_type = genomic RNA
tatagtggtaggcgttcctc

SEQ ID NO: 315 - RNA, 20 nt, Macaca fascicularis
  source 1..20: mol_type = genomic RNA
ctcttaaagcacagtcccgg

SEQ ID NO: 316 - RNA, 20 nt, Macaca fascicularis
  source 1..20: mol_type = genomic RNA
aatgcgccaaacatccggta

SEQ ID NO: 317 - RNA, 20 nt, Macaca fascicularis
  source 1..20: mol_type = genomic RNA
ttgccaaaagtacgtcgagc

SEQ ID NO: 318 - RNA, 20 nt, Macaca fascicularis
  source 1..20: mol_type = genomic RNA
tataaaggtgctgaataacg

SEQ ID NO: 319 - RNA, 20 nt, Macaca fascicularis
  source 1..20: mol_type = genomic RNA
cgtcgagcaggtgcaatttc

SEQ ID NO: 320 - RNA, 20 nt, Macaca fascicularis
  source 1..20: mol_type = genomic RNA
tgctcgacgtacttttggca

SEQ ID NO: 321 - RNA, 20 nt, Macaca fascicularis
  source 1..20: mol_type = genomic RNA
ggcttcccttaccggatgtt

SEQ ID NO: 322 - RNA, 20 nt, Macaca fascicularis
  source 1..20: mol_type = genomic RNA
caactgttgggtaactggat

SEQ ID NO: 323 - RNA, 20 nt, Macaca fascicularis
  source 1..20: mol_type = genomic RNA
gtgctgaataacgtggaatc

SEQ ID NO: 324 - RNA, 20 nt, Macaca fascicularis
  source 1..20: mol_type = genomic RNA
cgggtaaattttagaatggc

SEQ ID NO: 325 - RNA, 20 nt, Macaca fascicularis
  source 1..20: mol_type = genomic RNA
atgcgccaaacatccggtaa

SEQ ID NO: 326 - RNA, 20 nt, Macaca fascicularis
  source 1..20: mol_type = genomic RNA
ctatgagtgaccctccacac

SEQ ID NO: 327 - RNA, 20 nt, Macaca fascicularis
  source 1..20: mol_type = genomic RNA
ggcaacatccacatccgaga

SEQ ID NO: 328 - RNA, 20 nt, Macaca fascicularis
  source 1..20: mol_type = genomic RNA
ttacgttctatacgaatgca

SEQ ID NO: 329 - RNA, 20 nt, Macaca fascicularis
  source 1..20: mol_type = genomic RNA
ctccgggactgtgctttaag

SEQ ID NO: 330 - RNA, 20 nt, Macaca fascicularis
  source 1..20: mol_type = genomic RNA
gtcccatatgtaatcctagt

SEQ ID NO: 331 - RNA, 20 nt, Macaca fascicularis
  source 1..20: mol_type = genomic RNA
aaaacaagctcacgcattgt

SEQ ID NO: 332 - RNA, 20 nt, Macaca fascicularis
  source 1..20: mol_type = genomic RNA
ttcagcacctttatagtggt

SEQ ID NO: 333 - RNA, 20 nt, Macaca fascicularis
  source 1..20: mol_type = genomic RNA
acaagctcacgcattgttgg

SEQ ID NO: 334 - RNA, 20 nt, Macaca fascicularis
  source 1..20: mol_type = genomic RNA
gttcgacacacaaaagcatc

SEQ ID NO: 335 - RNA, 20 nt, Macaca fascicularis
  source 1..20: mol_type = genomic RNA
gggcgaaggctgtgcccgca

SEQ ID NO: 336 - RNA, 20 nt, Macaca fascicularis
  source 1..20: mol_type = genomic RNA
gtcactcataggacaccagt

SEQ ID NO: 337 - RNA, 20 nt, Macaca fascicularis
  source 1..20: mol_type = genomic RNA
agcaagttccatcaatgaca

SEQ ID NO: 338 - RNA, 20 nt, Macaca fascicularis
  source 1..20: mol_type = genomic RNA
aacgtaaagaagaggcagct

SEQ ID NO: 339 - RNA, 20 nt, Macaca fascicularis
  source 1..20: mol_type = genomic RNA
tgccaccgagacatttataa

SEQ ID NO: 340 - RNA, 20 nt, Macaca fascicularis
  source 1..20: mol_type = genomic RNA
gtgtttgtgtcacctttgga

SEQ ID NO: 341 - RNA, 20 nt, Macaca fascicularis
  source 1..20: mol_type = genomic RNA
ggattacatatgggacacaa

SEQ ID NO: 342 - RNA, 20 nt, Macaca fascicularis
  source 1..20: mol_type = genomic RNA
acacttacccatcaaagcag

SEQ ID NO: 343 - RNA, 20 nt, Macaca fascicularis
  source 1..20: mol_type = genomic RNA
cagtgtaattcaaaggagcc

SEQ ID NO: 344 - RNA, 20 nt, Macaca fascicularis
  source 1..20: mol_type = genomic RNA
aggattacatatgggacaca

SEQ ID NO: 345 - RNA, 20 nt, Macaca fascicularis
  source 1..20: mol_type = genomic RNA
ttcctttataaatgtctcgg

SEQ ID NO: 346 - RNA, 20 nt, Macaca fascicularis
  source 1..20: mol_type = genomic RNA
cctcaagaaaacaccacatc

SEQ ID NO: 347 - RNA, 20 nt, Macaca fascicularis
  source 1..20: mol_type = genomic RNA
agagcagtgatggaaacgct

SEQ ID NO: 348 - RNA, 20 nt, Macaca fascicularis
  source 1..20: mol_type = genomic RNA
tctccaactaggattacata

SEQ ID NO: 349 - RNA, 20 nt, Macaca fascicularis
  source 1..20: mol_type = genomic RNA
actcccagaagactgtaagg

SEQ ID NO: 350 - RNA, 20 nt, Macaca fascicularis
  source 1..20: mol_type = genomic RNA
agcatctggggcgagaactc

SEQ ID NO: 351 - RNA, 20 nt, Macaca fascicularis
  source 1..20: mol_type = genomic RNA
tcgacacacaaaagcatctg

SEQ ID NO: 352 - RNA, 20 nt, Macaca fascicularis
  source 1..20: mol_type = genomic RNA
ttggaggaacaaactcttct

SEQ ID NO: 353 - RNA, 20 nt, Macaca fascicularis
  source 1..20: mol_type = genomic RNA
tataaaggaattgatatgag

SEQ ID NO: 354 - RNA, 20 nt, Macaca fascicularis
  source 1..20: mol_type = genomic RNA
aactgttgggtaactggatg

SEQ ID NO: 355 - RNA, 20 nt, Macaca fascicularis
  source 1..20: mol_type = genomic RNA
atctggcagtgctgggcgtt

SEQ ID NO: 356 - RNA, 20 nt, Macaca fascicularis
  source 1..20: mol_type = genomic RNA
cttgcaaacacaatggaatg

SEQ ID NO: 357 - RNA, 20 nt, Macaca fascicularis
  source 1..20: mol_type = genomic RNA
tctcctccttacagtcttct

SEQ ID NO: 358 - RNA, 20 nt, Macaca fascicularis
  source 1..20: mol_type = genomic RNA
ctgtgactcagggagattca

SEQ ID NO: 359 - RNA, 20 nt, Macaca fascicularis
  source 1..20: mol_type = genomic RNA
ggcacagccttcgccccagc

SEQ ID NO: 360 - RNA, 20 nt, Macaca fascicularis
  source 1..20: mol_type = genomic RNA
ctgggcgttcggggtgtaca

SEQ ID NO: 361 - RNA, 20 nt, Macaca fascicularis
  source 1..20: mol_type = genomic RNA
gatgtttggcgcatttatag

SEQ ID NO: 362 - RNA, 20 nt, Macaca fascicularis
  source 1..20: mol_type = genomic RNA
cttcggatggttctccaact

SEQ ID NO: 363 - RNA, 20 nt, Macaca fascicularis
  source 1..20: mol_type = genomic RNA
ctataaatgcgccaaacatc

SEQ ID NO: 364 - RNA, 20 nt, Macaca fascicularis
  source 1..20: mol_type = genomic RNA
ccaactgttgggtaactgga

SEQ ID NO: 365 - RNA, 20 nt, Macaca fascicularis
  source 1..20: mol_type = genomic RNA
ctcccgggtaaattttagaa

SEQ ID NO: 366 - RNA, 20 nt, Macaca fascicularis
  source 1..20: mol_type = genomic RNA
tatcgccttaataaaactcc

SEQ ID NO: 367 - RNA, 20 nt, Macaca fascicularis
  source 1..20: mol_type = genomic RNA
gcatcttgccttctcggatg

SEQ ID NO: 368 - RNA, 20 nt, Macaca fascicularis
  source 1..20: mol_type = genomic RNA
tcgtatagaacgtaaagaag

SEQ ID NO: 369 - RNA, 20 nt, Macaca fascicularis
  source 1..20: mol_type = genomic RNA
ccattgtgtttgcaagctaa

SEQ ID NO: 370 - RNA, 20 nt, Macaca fascicularis
  source 1..20: mol_type = genomic RNA
aaattggcagcgaatgttat

SEQ ID NO: 371 - RNA, 20 nt, Macaca fascicularis
  source 1..20: mol_type = genomic RNA
ccatccagttacccaacagt

SEQ ID NO: 372 - RNA, 20 nt, Macaca fascicularis
  source 1..20: mol_type = genomic RNA
aactggatggggcttctcga

SEQ ID NO: 373 - RNA, 20 nt, Macaca fascicularis
  source 1..20: mol_type = genomic RNA
ctccaactaggattacatat

SEQ ID NO: 374 - RNA, 20 nt, Macaca fascicularis
  source 1..20: mol_type = genomic RNA
catccgagaaggcaagatgc

SEQ ID NO: 375 - RNA, 20 nt, Macaca fascicularis
  source 1..20: mol_type = genomic RNA
ttgaatgtgactttcgttaa

SEQ ID NO: 376 - RNA, 20 nt, Macaca fascicularis
  source 1..20: mol_type = genomic RNA
atgtcattgatggaacttgc

SEQ ID NO: 377 - RNA, 20 nt, Macaca fascicularis
  source 1..20: mol_type = genomic RNA
ttgatgaccacactgcttta

SEQ ID NO: 378 - RNA, 20 nt, Macaca fascicularis
  source 1..20: mol_type = genomic RNA
ctgtgtggagggtcactcat

SEQ ID NO: 379 - RNA, 20 nt, Macaca fascicularis
  source 1..20: mol_type = genomic RNA
ggtggaatgtgcacatcatc

SEQ ID NO: 380 - RNA, 20 nt, Macaca fascicularis
  source 1..20: mol_type = genomic RNA
ttcttaagattatcttcgga

SEQ ID NO: 381 - RNA, 20 nt, Macaca fascicularis
  source 1..20: mol_type = genomic RNA
cctttggaaggtaggcatat

SEQ ID NO: 382 - RNA, 20 nt, Macaca fascicularis
  source 1..20: mol_type = genomic RNA
tccattgtgtttgcaagcta

SEQ ID NO: 383 - RNA, 20 nt, Macaca fascicularis
  source 1..20: mol_type = genomic RNA
cctgtgactcagggagattc

SEQ ID NO: 384 - RNA, 20 nt, Macaca fascicularis
  source 1..20: mol_type = genomic RNA
tgcacatcatctggcagtgc

SEQ ID NO: 385 - RNA, 20 nt, Macaca fascicularis
  source 1..20: mol_type = genomic RNA
gttattcagcacctttatag

SEQ ID NO: 386 - RNA, 20 nt, Macaca fascicularis
  source 1..20: mol_type = genomic RNA
ggtcactcataggacaccag

SEQ ID NO: 387-399 - skipped (13 entries)

SEQ ID NO: 400 - RNA, 80 nt, synthetic construct; identical to SEQ ID NO: 168
  misc_feature 1..80: note = Synthetic
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 401 - RNA, 80 nt, synthetic construct; identical to SEQ ID NO: 168
  misc_feature 1..80: note = Synthetic
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 402 - RNA, 80 nt, synthetic construct; identical to SEQ ID NO: 168
  misc_feature 1..80: note = Synthetic
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  source 1..80: mol_type = other RNA

SEQ ID NO: 403 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  source 1..80: mol_type = other RNA

SEQ ID NO: 404 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  source 1..80: mol_type = other RNA

SEQ ID NO: 405 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 406 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 407 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 408 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 409 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 410 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-fluoro modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 411 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-fluoro modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-O-methyl modification
  modified_base 29: mod_base = OTHER; note = 2'-fluoro modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 412 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 413 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-fluoro modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 414 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-fluoro modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-O-methyl modification
  modified_base 29: mod_base = OTHER; note = 2'-fluoro modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 415 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 416 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-fluoro modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 417 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-fluoro modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-O-methyl modification
  modified_base 29: mod_base = OTHER; note = 2'-fluoro modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 418 - RNA, 80 nt, synthetic construct; identical to SEQ ID NO: 168
  misc_feature 1..80: note = Synthetic
  modified_base 7: mod_base = OTHER; note = 2'-O-methyl modification
  modified_base 8: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 419 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 21: mod_base = OTHER; note = 2'-O-methyl modification
  modified_base 22: mod_base = OTHER; note = 2'-O-methyl modification
  modified_base 23: mod_base = OTHER; note = 2'-O-methyl modification
  modified_base 24: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 420 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 45: mod_base = OTHER; note = 2'-fluoro modification
  modified_base 46: mod_base = OTHER; note = 2'-fluoro modification
  modified_base 47: mod_base = OTHER; note = 2'-fluoro modification
  modified_base 48: mod_base = OTHER; note = 2'-fluoro modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 421 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 46: mod_base = OTHER; note = 2'-O-methyl modification
  modified_base 47: mod_base = OTHER; note = 2'-O-methyl modification
  modified_base 48: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 422 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 7: mod_base = OTHER; note = 2'-O-methyl modification
  modified_base 8: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 21: mod_base = OTHER; note = 2'-O-methyl modification
  modified_base 22: mod_base = OTHER; note = 2'-O-methyl modification
  modified_base 23: mod_base = OTHER; note = 2'-O-methyl modification
  modified_base 24: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-fluoro modification
  modified_base 29: mod_base = OTHER; note = 2'-O-methyl modification
  modified_base 30: mod_base = OTHER; note = 2'-O-methyl modification
  modified_base 46: mod_base = OTHER; note = 2'-O-methyl modification
  modified_base 47: mod_base = OTHER; note = 2'-O-methyl modification
  modified_base 48: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 423 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification
  modified_base 78: mod_base = OTHER; note = 2'-O-methyl modification
  modified_base 79: mod_base = OTHER; note = 2'-O-methyl modification
  modified_base 80: mod_base = OTHER; note = 2'-O-methyl modification
  source 1..80: mol_type = other RNA

SEQ ID NO: 424 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 425 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-fluoro modification
  modified_base 71: mod_base = OTHER; note = 2'-fluoro modification
  modified_base 72: mod_base = OTHER; note = 2'-fluoro modification
  modified_base 73: mod_base = OTHER; note = 2'-fluoro modification
  modified_base 74: mod_base = OTHER; note = 2'-fluoro modification
  modified_base 75: mod_base = OTHER; note = 2'-fluoro modification
  modified_base 76: mod_base = OTHER; note = 2'-fluoro modification
  modified_base 77: mod_base = OTHER; note = 2'-fluoro modification and phosphorothioate bond
  modified_base 78: mod_base = OTHER; note = 2'-fluoro modification and phosphorothioate bond
  modified_base 79: mod_base = OTHER; note = 2'-fluoro modification and phosphorothioate bond
  modified_base 80: mod_base = OTHER; note = 2'-O-methyl modification
  source 1..80: mol_type = other RNA

SEQ ID NO: 426 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-fluoro modification
  modified_base 50: mod_base = OTHER; note = 2'-O-methyl modification
  modified_base 51: mod_base = OTHER; note = 2'-fluoro modification
  modified_base 52: mod_base = OTHER; note = 2'-O-methyl modification
  modified_base 53: mod_base = OTHER; note = 2'-fluoro modification
  modified_base 54: mod_base = OTHER; note = 2'-O-methyl modification
  modified_base 55: mod_base = OTHER; note = 2'-fluoro modification
  modified_base 56: mod_base = OTHER; note = 2'-O-methyl modification
  modified_base 57: mod_base = OTHER; note = 2'-fluoro modification
  modified_base 58: mod_base = OTHER; note = 2'-O-methyl modification
  modified_base 59: mod_base = OTHER; note = 2'-fluoro modification
  modified_base 60: mod_base = OTHER; note = 2'-O-methyl modification
  modified_base 61: mod_base = OTHER; note = 2'-fluoro modification
  modified_base 62: mod_base = OTHER; note = 2'-O-methyl modification
  modified_base 63: mod_base = OTHER; note = 2'-fluoro modification
  modified_base 64: mod_base = OTHER; note = 2'-O-methyl modification
  modified_base 65: mod_base = OTHER; note = 2'-fluoro modification
  modified_base 66: mod_base = OTHER; note = 2'-O-methyl modification
  modified_base 67: mod_base = OTHER; note = 2'-fluoro modification
  modified_base 68: mod_base = OTHER; note = 2'-O-methyl modification
  modified_base 69: mod_base = OTHER; note = 2'-fluoro modification
  modified_base 70: mod_base = OTHER; note = 2'-O-methyl modification
  modified_base 71: mod_base = OTHER; note = 2'-fluoro modification
  modified_base 72: mod_base = OTHER; note = 2'-O-methyl modification
  modified_base 73: mod_base = OTHER; note = 2'-fluoro modification
  modified_base 74: mod_base = OTHER; note = 2'-O-methyl modification
  modified_base 75: mod_base = OTHER; note = 2'-fluoro modification
  modified_base 76: mod_base = OTHER; note = 2'-O-methyl modification
  modified_base 77: mod_base = OTHER; note = 2'-fluoro modification and phosphorothioate bond
  modified_base 78: mod_base = OTHER; note = 2'-O-methyl modification and phosphorothioate bond
  modified_base 79: mod_base = OTHER; note = 2'-fluoro modification and phosphorothioate bond
  modified_base 80: mod_base = OTHER; note = 2'-O-methyl modification
  source 1..80: mol_type = other RNA

SEQ ID NO: 427 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 428 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 429 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 430 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 431 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-fluoro modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 432 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-fluoro modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-O-methyl modification
  modified_base 29: mod_base = OTHER; note = 2'-fluoro modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 433 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 434 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-fluoro modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 435 - RNA, 80 nt, synthetic construct; identical to SEQ ID NO: 168
  misc_feature 1..80: note = Synthetic
  modified_base 1: mod_base = OTHER; note = 2'-O-methyl modification
  modified_base 6: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-fluoro modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-O-methyl modification
  modified_base 29: mod_base = OTHER; note = 2'-fluoro modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 436 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 437 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-fluoro modification
  modified_base 29: mod_base = OTHER; note = 2'-O-methyl modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 438 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 25: mod_base = OTHER; note = 2'-fluoro modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-O-methyl modification
  modified_base 29: mod_base = OTHER; note = 2'-fluoro modification
  modified_base 30: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 439 - RNA, 80 nt, synthetic construct; identical to SEQ ID NO: 168
  misc_feature 1..80: note = Synthetic
  modified_base 7: mod_base = OTHER; note = 2'-O-methyl modification
  modified_base 8: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 440 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 21: mod_base = OTHER; note = 2'-O-methyl modification
  modified_base 22: mod_base = OTHER; note = 2'-O-methyl modification
  modified_base 23: mod_base = OTHER; note = 2'-O-methyl modification
  modified_base 24: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 441 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 45: mod_base = OTHER; note = 2'-fluoro modification
  modified_base 46: mod_base = OTHER; note = 2'-fluoro modification
  modified_base 47: mod_base = OTHER; note = 2'-fluoro modification
  modified_base 48: mod_base = OTHER; note = 2'-fluoro modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 442 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 45: mod_base = OTHER; note = 2'-O-methyl modification
  modified_base 46: mod_base = OTHER; note = 2'-O-methyl modification
  modified_base 47: mod_base = OTHER; note = 2'-O-methyl modification
  modified_base 48: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 443 - RNA, 80 nt, synthetic construct; identical to SEQ ID NO: 168
  misc_feature 1..80: note = Synthetic
  modified_base 1: mod_base = OTHER; note = 2'-fluoro modification
  modified_base 2: mod_base = OTHER; note = 2'-fluoro modification
  modified_base 3: mod_base = OTHER; note = 2'-fluoro modification
  modified_base 4: mod_base = OTHER; note = 2'-fluoro modification
  modified_base 5: mod_base = OTHER; note = 2'-fluoro modification
  modified_base 6: mod_base = OTHER; note = 2'-fluoro modification
  modified_base 7: mod_base = OTHER; note = 2'-O-methyl modification
  modified_base 8: mod_base = OTHER; note = 2'-O-methyl modification
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 21: mod_base = OTHER; note = 2'-O-methyl modification
  modified_base 22: mod_base = OTHER; note = 2'-O-methyl modification
  modified_base 23: mod_base = OTHER; note = 2'-O-methyl modification
  modified_base 24: mod_base = OTHER; note = 2'-O-methyl modification
  modified_base 25: mod_base = OTHER; note = 2'-O-methyl modification
  modified_base 26: mod_base = OTHER; note = 2'-O-methyl modification
  modified_base 27: mod_base = OTHER; note = 2'-fluoro modification
  modified_base 28: mod_base = OTHER; note = 2'-fluoro modification
  modified_base 29: mod_base = OTHER; note = 2'-O-methyl modification
  modified_base 30: mod_base = OTHER; note = 2'-O-methyl modification
  modified_base 46: mod_base = OTHER; note = 2'-O-methyl modification
  modified_base 47: mod_base = OTHER; note = 2'-O-methyl modification
  modified_base 48: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification and phosphorothioate bond
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 444 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification
  modified_base 78: mod_base = OTHER; note = 2'-O-methyl modification
  modified_base 79: mod_base = OTHER; note = 2'-O-methyl modification
  modified_base 80: mod_base = OTHER; note = 2'-O-methyl modification
  source 1..80: mol_type = other RNA

SEQ ID NO: 445 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification
  modified_base 78: mod_base = OTHER; note = 2'-O-methyl modification and phosphorothioate bond
  modified_base 79: mod_base = OTHER; note = 2'-O-methyl modification and phosphorothioate bond
  modified_base 80: mod_base = OTHER; note = 2'-O-methyl modification
  source 1..80: mol_type = other RNA

SEQ ID NO: 446 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-O-methyl modification
  modified_base 50: mod_base = OTHER; note = 2'-O-methyl modification
  modified_base 51: mod_base = OTHER; note = 2'-O-methyl modification
  modified_base 52: mod_base = OTHER; note = 2'-O-methyl modification
  modified_base 53: mod_base = OTHER; note = 2'-O-methyl modification
  modified_base 54: mod_base = OTHER; note = 2'-O-methyl modification
  modified_base 55: mod_base = OTHER; note = 2'-O-methyl modification
  modified_base 56: mod_base = OTHER; note = 2'-O-methyl modification
  modified_base 57: mod_base = OTHER; note = 2'-O-methyl modification
  modified_base 58: mod_base = OTHER; note = 2'-O-methyl modification
  modified_base 59: mod_base = OTHER; note = 2'-O-methyl modification
  modified_base 60: mod_base = OTHER; note = 2'-O-methyl modification
  modified_base 61: mod_base = OTHER; note = 2'-O-methyl modification
  modified_base 62: mod_base = OTHER; note = 2'-O-methyl modification
  modified_base 63: mod_base = OTHER; note = 2'-O-methyl modification
  modified_base 64: mod_base = OTHER; note = 2'-O-methyl modification
  modified_base 65: mod_base = OTHER; note = 2'-O-methyl modification
  modified_base 66: mod_base = OTHER; note = 2'-O-methyl modification
  modified_base 67: mod_base = OTHER; note = 2'-O-methyl modification
  modified_base 68: mod_base = OTHER; note = 2'-O-methyl modification
  modified_base 69: mod_base = OTHER; note = 2'-O-methyl modification
  modified_base 70: mod_base = OTHER; note = 2'-fluoro modification
  modified_base 71: mod_base = OTHER; note = 2'-fluoro modification
  modified_base 72: mod_base = OTHER; note = 2'-fluoro modification
  modified_base 73: mod_base = OTHER; note = 2'-fluoro modification
  modified_base 74: mod_base = OTHER; note = 2'-fluoro modification
  modified_base 75: mod_base = OTHER; note = 2'-fluoro modification
  modified_base 76: mod_base = OTHER; note = 2'-fluoro modification
  modified_base 77: mod_base = OTHER; note = 2'-fluoro modification and phosphorothioate bond
  modified_base 78: mod_base = OTHER; note = 2'-fluoro modification and phosphorothioate bond
  modified_base 79: mod_base = OTHER; note = 2'-fluoro modification and phosphorothioate bond
  modified_base 80: mod_base = OTHER; note = 2'-O-methyl modification
  source 1..80: mol_type = other RNA

SEQ ID NO: 447 - RNA, 80 nt, synthetic construct; identical to SEQ ID NO: 168
  misc_feature 1..80: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 49: mod_base = OTHER; note = 2'-fluoro modification
  modified_base 50: mod_base = OTHER; note = 2'-O-methyl modification
  modified_base 51: mod_base = OTHER; note = 2'-fluoro modification
  modified_base 52: mod_base = OTHER; note = 2'-O-methyl modification
  modified_base 53: mod_base = OTHER; note = 2'-fluoro modification
  modified_base 54: mod_base = OTHER; note = 2'-O-methyl modification
  modified_base 55: mod_base = OTHER; note = 2'-fluoro modification
  modified_base 56: mod_base = OTHER; note = 2'-O-methyl modification
  modified_base 57: mod_base = OTHER; note = 2'-fluoro modification
  modified_base 58: mod_base = OTHER; note = 2'-O-methyl modification
  modified_base 59: mod_base = OTHER; note = 2'-fluoro modification
  modified_base 60: mod_base = OTHER; note = 2'-O-methyl modification
  modified_base 61: mod_base = OTHER; note = 2'-fluoro modification
  modified_base 62: mod_base = OTHER; note = 2'-O-methyl modification
  modified_base 63: mod_base = OTHER; note = 2'-fluoro modification
  modified_base 64: mod_base = OTHER; note = 2'-O-methyl modification
  modified_base 65: mod_base = OTHER; note = 2'-fluoro modification
  modified_base 66: mod_base = OTHER; note = 2'-O-methyl modification
  modified_base 67: mod_base = OTHER; note = 2'-fluoro modification
  modified_base 68: mod_base = OTHER; note = 2'-O-methyl modification
  modified_base 69: mod_base = OTHER; note = 2'-fluoro modification
  modified_base 70: mod_base = OTHER; note = 2'-O-methyl modification
  modified_base 71: mod_base = OTHER; note = 2'-fluoro modification
  modified_base 72: mod_base = OTHER; note = 2'-O-methyl modification
  modified_base 73: mod_base = OTHER; note = 2'-fluoro modification
  modified_base 74: mod_base = OTHER; note = 2'-O-methyl modification
  modified_base 75: mod_base = OTHER; note = 2'-fluoro modification
  modified_base 76: mod_base = OTHER; note = 2'-O-methyl modification
  modified_base 77: mod_base = OTHER; note = 2'-fluoro modification and phosphorothioate bond
  modified_base 78: mod_base = OTHER; note = 2'-O-methyl modification and phosphorothioate bond
  modified_base 79: mod_base = OTHER; note = 2'-fluoro modification and phosphorothioate bond
  modified_base 80: mod_base = OTHER; note = 2'-O-methyl modification
  source 1..80: mol_type = other RNA

SEQ ID NO: 448-449 - skipped (2 entries)

SEQ ID NO: 450 - RNA, 68 nt, synthetic construct; identical to SEQ ID NO: 173
  misc_feature 1..68: note = Synthetic
  modified_base 9: mod_base = OTHER; note = 2'-O-methyl modification
  modified_base 10: mod_base = OTHER; note = 2'-O-methyl modification
  modified_base 11: mod_base = OTHER; note = 2'-O-methyl modification
  modified_base 12: mod_base = OTHER; note = 2'-O-methyl modification
  modified_base 13: mod_base = OTHER; note = 2'-O-methyl modification
  modified_base 14: mod_base = OTHER; note = 2'-O-methyl modification
  modified_base 15: mod_base = OTHER; note = 2'-O-methyl modification
  modified_base 16: mod_base = OTHER; note = 2'-O-methyl modification
  modified_base 17: mod_base = OTHER; note = 2'-O-methyl modification
  modified_base 18: mod_base = OTHER; note = 2'-O-methyl modification
  modified_base 19: mod_base = OTHER; note = 2'-O-methyl modification
  modified_base 20: mod_base = OTHER; note = 2'-O-methyl modification
  modified_base 65: mod_base = OTHER; note = phosphorothioate bond
  modified_base 66: mod_base = OTHER; note = 2'-O-methyl modification and phosphorothioate bond
  modified_base 67: mod_base = OTHER; note = 2'-O-methyl modification and phosphorothioate bond
  modified_base 68: mod_base = OTHER; note = 2'-O-methyl modification
  source 1..68: mol_type = other RNA

SEQ ID NO: 451-499 - skipped (49 entries)

SEQ ID NO: 500 - RNA, 76 nt, synthetic construct; identical to SEQ ID NO: 172
  misc_feature 1..76: note = Synthetic
  source 1..76: mol_type = other RNA

SEQ ID NO: 501 - DNA, 4411 bp, synthetic construct
  misc_feature 1..4411: note = Synthetic
  source 1..4411: mol_type = other DNA
gggtcccgcagtcggcgtccagcggctctgcttgttcgtgtgtgtgtcgttgcaggccttattcggatccgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 502 - RNA, 4107 nt, synthetic construct
  misc_feature 1..4107: note = Synthetic
  source 1..4107: mol_type = other RNA
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagactag

SEQ ID NO: 503 - RNA, 4101 nt, synthetic construct
  misc_feature 1..4101: note = Synthetic
  source 1..4101: mol_type = other RNA
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagac

SEQ ID NO: 504 - RNA, 4179 nt, synthetic construct
  misc_feature 1..4179: note = Synthetic
  source 1..4179: mol_type = other RNA
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaagcggaagcccgaagaagaagagaaaggtcgacggaagcccgaagaagaagagaaaggtcgacagcggatag

SEQ ID NO: 505 - RNA, 4173 nt, synthetic construct
  misc_feature 1..4173: note = Synthetic
  source 1..4173: mol_type = other RNA
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaagcggaagcccgaagaagaagagaaaggtcgacggaagcccgaagaagaagagaaaggtcgacagcgga

SEQ ID NO: 506 - DNA, 4405 bp, synthetic construct
  misc_feature 1..4405: note = Synthetic
  source 1..4405: mol_type = other DNA
gggtcccgcagtcggcgtccagcggctctgcttgttcgtgtgtgtgtcgttgcaggccttattcggatccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 507 - DNA, 4140 bp, synthetic construct
  misc_feature 1..4140: note = Synthetic
  source 1..4140: mol_type = other DNA
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccaccggctggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcaaaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctag

SEQ ID NO: 508 - DNA, 4140 bp, synthetic construct
  misc_feature 1..4140: note = Synthetic
  source 1..4140: mol_type = other DNA
atggacaagaagtacagcatcggcctggacatcggcaccaacagcgtgggctgggccgtgatcaccgacgagtacaaggtgcccagcaagaagttcaaggtgctgggcaacaccgacagacacagcatcaagaagaacctgatcggcgccctgctgttcgacagcggcgagaccgccgaggccaccagactgaagagaaccgccagaagaagatacaccagaagaaagaacagaatctgctacctgcaggagatcttcagcaacgagatggccaaggtggacgacagcttcttccacagactggaggagagcttcctggtggaggaggacaagaagcacgagagacaccccatcttcggcaacatcgtggacgaggtggcctaccacgagaagtaccccaccatctaccacctgagaaagaagctggtggacagcaccgacaaggccgacctgagactgatctacctggccctggcccacatgatcaagttcagaggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgccagactgagcaagagcagaagactggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagagtgaacaccgagatcaccaaggcccccctgagcgccagcatgatcaagagatacgacgagcaccaccaggacctgaccctgctgaaggccctggtgagacagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaacagagaggacctgctgagaaagcagagaaccttcgacaacggcagcatcccccaccagatccacctgggcgagctgcacgccatcctgagaagacaggaggacttctaccccttcctgaaggacaacagagagaagatcgagaagatcctgaccttcagaatcccctactacgtgggccccctggccagaggcaacagcagattcgcctggatgaccagaaagagcgaggagaccatcaccccctggaacttcgaggaggtggtggacaagggcgccagcgcccagagcttcatcgagagaatgaccaacttcgacaagaacctgcccaacgagaaggtgctgcccaagcacagcctgctgtacgagtacttcaccgtgtacaacgagctgaccaaggtgaagtacgtgaccgagggcatgagaaagcccgccttcctgagcggcgagcagaagaaggccatcgtggacctgctgttcaagaccaacagaaaggtgaccgtgaagcagctgaaggaggactacttcaagaagatcgagtgcttcgacagcgtggagatcagcggcgtggaggacagattcaacgccagcctgggcacctaccacgacctgctgaagatcatcaaggacaaggacttcctggacaacgaggagaacgaggacatcctggaggacatcgtgctgaccctgaccctgttcgaggacagagagatgatcgaggagagactgaagacctacgcccacctgttcgacgacaaggtgatgaagcagctgaagagaagaagatacaccggctggggcagactgagcagaaagctgatcaacggcatcagagacaagcagagcggcaagaccatcctggacttcctgaagagcgacggcttcgccaacagaaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggcagacacaagcccgagaacatcgtgatcgagatggccagagagaaccagaccacccagaagggccagaagaacagcagagagagaatgaagagaatcgaggagggcatcaaggagctgggcagccagatcctgaaggagcaccccgtggagaacacccagctgcagaacgagaagctgtacctgtactacctgcagaacggcagagacatgtacgtggaccaggagctggacatcaacagactgagcgactacgacgtggaccacatcgtgccccagagcttcctgaaggacgacagcatcgacaacaaggtgctgaccagaagcgacaagaacagaggcaagagcgacaacgtgcccagcgaggaggtggtgaagaagatgaagaactactggagacagctgctgaacgccaagctgatcacccagagaaagttcgacaacctgaccaaggccgagagaggcggcctgagcgagctggacaaggccggcttcatcaagagacagctggtggagaccagacagatcaccaagcacgtggcccagatcctggacagcagaatgaacaccaagtacgacgagaacgacaagctgatcagagaggtgaaggtgatcaccctgaagagcaagctggtgagcgacttcagaaaggacttccagttctacaaggtgagagagatcaacaactaccaccacgcccacgacgcctacctgaacgccgtggtgggcaccgccctgatcaagaagtaccccaagctggagagcgagttcgtgtacggcgactacaaggtgtacgacgtgagaaagatgatcgccaagagcgagcaggagatcggcaaggccaccgccaagtacttcttctacagcaacatcatgaacttcttcaagaccgagatcaccctggccaacggcgagatcagaaagagacccctgatcgagaccaacggcgagaccggcgagatcgtgtgggacaagggcagagacttcgccaccgtgagaaaggtgctgagcatgccccaggtgaacatcgtgaagaagaccgaggtgcagaccggcggcttcagcaaggagagcatcctgcccaagagaaacagcgacaagctgatcgccagaaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagagaagcagcttcgagaagaaccccatcgacttcctggaggccaagggctacaaggaggtgaagaaggacctgatcatcaagctgcccaagtacagcctgttcgagctggagaacggcagaaagagaatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagagagtgatcctggccgacgccaacctggacaaggtgctgagcgcctacaacaagcacagagacaagcccatcagagagcaggccgagaacatcatccacctgttcaccctgaccaacctgggcgcccccgccgccttcaagtacttcgacaccaccatcgacagaaagagatacaccagcaccaaggaggtgctggacgccaccctgatccaccagagcatcaccggcctgtacgagaccagaatcgacctgagccagctgggcggcgacggcggcggcagccccaagaagaagagaaaggtgtga

SEQ ID NO: 509 - DNA, 4411 bp, synthetic construct
  misc_feature 1..4411: note = Synthetic
  source 1..4411: mol_type = other DNA
gggtcccgcagtcggcgtccagcggctctgcttgttcgtgtgtgtgtcgttgcaggccttattcggatccgccaccatggacaagaagtacagcatcggcctggacatcggcaccaacagcgtgggctgggccgtgatcaccgacgagtacaaggtgcccagcaagaagttcaaggtgctgggcaacaccgacagacacagcatcaagaagaacctgatcggcgccctgctgttcgacagcggcgagaccgccgaggccaccagactgaagagaaccgccagaagaagatacaccagaagaaagaacagaatctgctacctgcaggagatcttcagcaacgagatggccaaggtggacgacagcttcttccacagactggaggagagcttcctggtggaggaggacaagaagcacgagagacaccccatcttcggcaacatcgtggacgaggtggcctaccacgagaagtaccccaccatctaccacctgagaaagaagctggtggacagcaccgacaaggccgacctgagactgatctacctggccctggcccacatgatcaagttcagaggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgccagactgagcaagagcagaagactggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagagtgaacaccgagatcaccaaggcccccctgagcgccagcatgatcaagagatacgacgagcaccaccaggacctgaccctgctgaaggccctggtgagacagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaacagagaggacctgctgagaaagcagagaaccttcgacaacggcagcatcccccaccagatccacctgggcgagctgcacgccatcctgagaagacaggaggacttctaccccttcctgaaggacaacagagagaagatcgagaagatcctgaccttcagaatcccctactacgtgggccccctggccagaggcaacagcagattcgcctggatgaccagaaagagcgaggagaccatcaccccctggaacttcgaggaggtggtggacaagggcgccagcgcccagagcttcatcgagagaatgaccaacttcgacaagaacctgcccaacgagaaggtgctgcccaagcacagcctgctgtacgagtacttcaccgtgtacaacgagctgaccaaggtgaagtacgtgaccgagggcatgagaaagcccgccttcctgagcggcgagcagaagaaggccatcgtggacctgctgttcaagaccaacagaaaggtgaccgtgaagcagctgaaggaggactacttcaagaagatcgagtgcttcgacagcgtggagatcagcggcgtggaggacagattcaacgccagcctgggcacctaccacgacctgctgaagatcatcaaggacaaggacttcctggacaacgaggagaacgaggacatcctggaggacatcgtgctgaccctgaccctgttcgaggacagagagatgatcgaggagagactgaagacctacgcccacctgttcgacgacaaggtgatgaagcagctgaagagaagaagatacaccggctggggcagactgagcagaaagctgatcaacggcatcagagacaagcagagcggcaagaccatcctggacttcctgaagagcgacggcttcgccaacagaaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggcagacacaagcccgagaacatcgtgatcgagatggccagagagaaccagaccacccagaagggccagaagaacagcagagagagaatgaagagaatcgaggagggcatcaaggagctgggcagccagatcctgaaggagcaccccgtggagaacacccagctgcagaacgagaagctgtacctgtactacctgcagaacggcagagacatgtacgtggaccaggagctggacatcaacagactgagcgactacgacgtggaccacatcgtgccccagagcttcctgaaggacgacagcatcgacaacaaggtgctgaccagaagcgacaagaacagaggcaagagcgacaacgtgcccagcgaggaggtggtgaagaagatgaagaactactggagacagctgctgaacgccaagctgatcacccagagaaagttcgacaacctgaccaaggccgagagaggcggcctgagcgagctggacaaggccggcttcatcaagagacagctggtggagaccagacagatcaccaagcacgtggcccagatcctggacagcagaatgaacaccaagtacgacgagaacgacaagctgatcagagaggtgaaggtgatcaccctgaagagcaagctggtgagcgacttcagaaaggacttccagttctacaaggtgagagagatcaacaactaccaccacgcccacgacgcctacctgaacgccgtggtgggcaccgccctgatcaagaagtaccccaagctggagagcgagttcgtgtacggcgactacaaggtgtacgacgtgagaaagatgatcgccaagagcgagcaggagatcggcaaggccaccgccaagtacttcttctacagcaacatcatgaacttcttcaagaccgagatcaccctggccaacggcgagatcagaaagagacccctgatcgagaccaacggcgagaccggcgagatcgtgtgggacaagggcagagacttcgccaccgtgagaaaggtgctgagcatgccccaggtgaacatcgtgaagaagaccgaggtgcagaccggcggcttcagcaaggagagcatcctgcccaagagaaacagcgacaagctgatcgccagaaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagagaagcagcttcgagaagaaccccatcgacttcctggaggccaagggctacaaggaggtgaagaaggacctgatcatcaagctgcccaagtacagcctgttcgagctggagaacggcagaaagagaatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagagagtgatcctggccgacgccaacctggacaaggtgctgagcgcctacaacaagcacagagacaagcccatcagagagcaggccgagaacatcatccacctgttcaccctgaccaacctgggcgcccccgccgccttcaagtacttcgacaccaccatcgacagaaagagatacaccagcaccaaggaggtgctggacgccaccctgatccaccagagcatcaccggcctgtacgagaccagaatcgacctgagccagctgggcggcgacggcggcggcagccccaagaagaagagaaaggtgtgactagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 510 - DNA, 4140 bp, synthetic construct
  misc_feature 1..4140: note = Synthetic
  source 1..4140: mol_type = other DNA
atggacaagaagtactctatcggtttggacatcggtaccaactctgtcggttgggccgtcatcaccgacgaatacaaggtcccatctaagaagttcaaggtcttgggtaacaccgacagacactctatcaagaagaacttgatcggtgccttgttgttcgactctggtgaaaccgccgaagccaccagattgaagagaaccgccagaagaagatacaccagaagaaagaacagaatctgctacttgcaagaaatcttctctaacgaaatggccaaggtcgacgactctttcttccacagattggaagaatctttcttggtcgaagaagacaagaagcacgaaagacacccaatcttcggtaacatcgtcgacgaagtcgcctaccacgaaaagtacccaaccatctaccacttgagaaagaagttggtcgactctaccgacaaggccgacttgagattgatctacttggccttggcccacatgatcaagttcagaggtcacttcttgatcgaaggtgacttgaacccagacaactctgacgtcgacaagttgttcatccaattggtccaaacctacaaccaattgttcgaagaaaacccaatcaacgcctctggtgtcgacgccaaggccatcttgtctgccagattgtctaagagcagaagattggaaaacttgatcgcccaattgccaggtgaaaagaagaacggtttgttcggtaacttgatcgccttgtctttgggtttgaccccaaacttcaagtctaacttcgacttggccgaagacgccaagttgcaattgtctaaggacacctacgacgacgacttggacaacttgttggcccaaatcggtgaccaatacgccgacttgttcttggccgccaagaacttgtctgacgccatcttgttgtctgacatcttgagagtcaacaccgaaatcaccaaggccccattgtctgcctctatgatcaagagatacgacgaacaccaccaagacttgaccttgttgaaggccttggtcagacaacaattgccagaaaagtacaaggaaatcttcttcgaccaatctaagaacggttacgccggttacatcgacggtggtgcctctcaagaagaattctacaagttcatcaagccaatcttggaaaagatggacggtaccgaagaattgttggtcaagttgaacagagaagacttgttgagaaagcaaagaaccttcgacaacggttctatcccacaccaaatccacttgggtgaattgcacgccatcttgagaagacaagaagacttctacccattcttgaaggacaacagagaaaagatcgaaaagatcttgaccttcagaatcccatactacgtcggtccattggccagaggtaacagcagattcgcctggatgaccagaaagtctgaagaaaccatcaccccatggaacttcgaagaagtcgtcgacaagggtgcctctgcccaatctttcatcgaaagaatgaccaacttcgacaagaacttgccaaacgaaaaggtcttgccaaagcactctttgttgtacgaatacttcaccgtctacaacgaattgaccaaggtcaagtacgtcaccgaaggtatgagaaagccagccttcttgtctggtgaacaaaagaaggccatcgtcgacttgttgttcaagaccaacagaaaggtcaccgtcaagcaattgaaggaagactacttcaagaagatcgaatgcttcgactctgtcgaaatctctggtgtcgaagacagattcaacgcctctttgggtacctaccacgacttgttgaagatcatcaaggacaaggacttcttggacaacgaagaaaacgaagacatcttggaagacatcgtcttgaccttgaccttgttcgaagacagagaaatgatcgaagaaagattgaagacctacgcccacttgttcgacgacaaggtcatgaagcaattgaagagaagaagatacaccggttggggtagattgagcagaaagttgatcaacggtatcagagacaagcaatctggtaagaccatcttggacttcttgaagtctgacggtttcgccaacagaaacttcatgcaattgatccacgacgactctttgaccttcaaggaagacatccaaaaggcccaagtctctggtcaaggtgactctttgcacgaacacatcgccaacttggccggttctccagccatcaagaagggtatcttgcaaaccgtcaaggtcgtcgacgaattggtcaaggtcatgggtagacacaagccagaaaacatcgtcatcgaaatggccagagaaaaccaaaccacccaaaagggtcaaaagaacagcagagaaagaatgaagagaatcgaagaaggtatcaaggaattgggttctcaaatcttgaaggaacacccagtcgaaaacacccaattgcaaaacgaaaagttgtacttgtactacttgcaaaacggtagagacatgtacgtcgaccaagaattggacatcaacagattgtctgactacgacgtcgaccacatcgtcccacaatctttcttgaaggacgactctatcgacaacaaggtcttgaccagatctgacaagaacagaggtaagtctgacaacgtcccatctgaagaagtcgtcaagaagatgaagaactactggagacaattgttgaacgccaagttgatcacccaaagaaagttcgacaacttgaccaaggccgaaagaggtggtttgtctgaattggacaaggccggtttcatcaagagacaattggtcgaaaccagacaaatcaccaagcacgtcgcccaaatcttggacagcagaatgaacaccaagtacgacgaaaacgacaagttgatcagagaagtcaaggtcatcaccttgaagtctaagttggtctctgacttcagaaaggacttccaattctacaaggtcagagaaatcaacaactaccaccacgcccacgacgcctacttgaacgccgtcgtcggtaccgccttgatcaagaagtacccaaagttggaatctgaattcgtctacggtgactacaaggtctacgacgtcagaaagatgatcgccaagtctgaacaagaaatcggtaaggccaccgccaagtacttcttctactctaacatcatgaacttcttcaagaccgaaatcaccttggccaacggtgaaatcagaaagagaccattgatcgaaaccaacggtgaaaccggtgaaatcgtctgggacaagggtagagacttcgccaccgtcagaaaggtcttgtctatgccacaagtcaacatcgtcaagaagaccgaagtccaaaccggtggtttctctaaggaatctatcttgccaaagagaaactctgacaagttgatcgccagaaagaaggactgggacccaaagaagtacggtggtttcgactctccaaccgtcgcctactctgtcttggtcgtcgccaaggtcgaaaagggtaagtctaagaagttgaagtctgtcaaggaattgttgggtatcaccatcatggaaagatcttctttcgaaaagaacccaatcgacttcttggaagccaagggttacaaggaagtcaagaaggacttgatcatcaagttgccaaagtactctttgttcgaattggaaaacggtagaaagagaatgttggcctctgccggtgaattgcaaaagggtaacgaattggccttgccatctaagtacgtcaacttcttgtacttggcctctcactacgaaaagttgaagggttctccagaagacaacgaacaaaagcaattgttcgtcgaacaacacaagcactacttggacgaaatcatcgaacaaatctctgaattctctaagagagtcatcttggccgacgccaacttggacaaggtcttgtctgcctacaacaagcacagagacaagccaatcagagaacaagccgaaaacatcatccacttgttcaccttgaccaacttgggtgccccagccgccttcaagtacttcgacaccaccatcgacagaaagagatacacctctaccaaggaagtcttggacgccaccttgatccaccaatctatcaccggtttgtacgaaaccagaatcgacttgtctcaattgggtggtgacggtggtggttctccaaagaagaagagaaaggtctaa

SEQ ID NO: 511 - DNA, 4140 bp, synthetic construct
  misc_feature 1..4140: note = Synthetic
  source 1..4140: mol_type = other DNA
atggacaagaagtactccatcggcctggacatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggcggcggctcccccaagaagaagcggaaggtgtga

SEQ ID NO: 512 - DNA, 4140 bp, synthetic construct
  misc_feature 1..4140: note = Synthetic
  source 1..4140: mol_type = other DNA
atggacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcggcggcagccccaagaagaagcggaaggtgtga

SEQ ID NO: 513 - DNA, 4179 bp, synthetic construct
  misc_feature 1..4179: note = Synthetic
  source 1..4179: mol_type = other DNA
atggacaagaagtactccatcggcctggacatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggctccggctcccccaagaagaagcggaaggtggacggctcccccaagaagaagcggaaggtggactccggctga

SEQ ID NO: 514 - DNA, 4179 bp, synthetic construct
  misc_feature 1..4179: note = Synthetic
  source 1..4179: mol_type = other DNA
atggacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcagcggcagccccaagaagaagcggaaggtggacggcagccccaagaagaagcggaaggtggacagcggctga

SEQ ID NO: 515 - DNA, 4107 bp, synthetic construct
  misc_feature 1..4107: note = Synthetic
  source 1..4107: mol_type = other DNA
atggacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgactga

SEQ ID NO: 516 - RNA, 4325 nt, synthetic construct
  misc_feature 1..4325: note = Synthetic
  source 1..4325: mol_type = other RNA
gggaagctcagaataaacgctcaactttggccggatctgccaccatggacaagaagtactccatcggcctggacatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggcggcggctcccccaagaagaagcggaaggtgtgactagcaccagcctcaagaacacccgaatggagtctctaagctacataataccaacttacactttacaaaatgttgtcccccaaaatgtagccattcgtatctgctcctaataaaaagaaagtttcttcacattctctcgag

SEQ ID NO: 517-599 - skipped (83 entries)

SEQ ID NO: 600 - protein, 7 aa, synthetic construct
  REGION 1..7: note = Synthetic
PKKKRKV

SEQ ID NO: 601 - protein, 7 aa, synthetic construct
  REGION 1..7: note = Synthetic
PKKKRRV

SEQ ID NO: 602 - protein, 16 aa, synthetic construct
  REGION 1..16: note = Synthetic
KRPAATKKAGQAKKKK

SEQ ID NO: 603 - RNA, 100 nt, synthetic construct
  misc_feature 1..100: note = Synthetic
  modified_base 1: mod_base = OTHER; note = 2'-O-methyl modification and phosphorothioate bond
  modified_base 2: mod_base = OTHER; note = 2'-O-methyl modification and phosphorothioate bond
  modified_base 3: mod_base = OTHER; note = 2'-O-methyl modification and phosphorothioate bond
  modified_base 29: mod_base = OTHER; note = 2'-O-methyl modification
  modified_base 30: mod_base = OTHER; note = 2'-O-methyl modification
  modified_base 31: mod_base = OTHER; note = 2'-O-methyl modification
  modified_base 32: mod_base = OTHER; note = 2'-O-methyl modification
  modified_base 33: mod_base = OTHER; note = 2'-O-methyl modification
  modified_base 34: mod_base = OTHER; note = 2'-O-methyl modification
  modified_base 35: mod_base = OTHER; note = 2'-O-methyl modification
  modified_base 36: mod_base = OTHER; note = 2'-O-methyl modification
  modified_base 37: mod_base = OTHER; note = 2'-O-methyl modification
  modified_base 38: mod_base = OTHER; note = 2'-O-methyl modification
  modified_base 39: mod_base = OTHER; note = 2'-O-methyl modification
  modified_base 40: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification
  modified_base 78: mod_base = OTHER; note = 2'-O-methyl modification
  modified_base 79: mod_base = OTHER; note = 2'-O-methyl modification
  modified_base 80: mod_base = OTHER; note = 2'-O-methyl modification
  modified_base 81: mod_base = OTHER; note = 2'-O-methyl modification
  modified_base 82: mod_base = OTHER; note = 2'-O-methyl modification
  modified_base 83: mod_base = OTHER; note = 2'-O-methyl modification
  modified_base 84: mod_base = OTHER; note = 2'-O-methyl modification
  modified_base 85: mod_base = OTHER; note = 2'-O-methyl modification
  modified_base 86: mod_base = OTHER; note = 2'-O-methyl modification
  modified_base 87: mod_base = OTHER; note = 2'-O-methyl modification
  modified_base 88: mod_base = OTHER; note = 2'-O-methyl modification
  modified_base 89: mod_base = OTHER; note = 2'-O-methyl modification
  modified_base 90: mod_base = OTHER; note = 2'-O-methyl modification
  modified_base 91: mod_base = OTHER; note = 2'-O-methyl modification
  modified_base 92: mod_base = OTHER; note = 2'-O-methyl modification
  modified_base 93: mod_base = OTHER; note = 2'-O-methyl modification
  modified_base 94: mod_base = OTHER; note = 2'-O-methyl modification
  modified_base 95: mod_base = OTHER; note = 2'-O-methyl modification
  modified_base 96: mod_base = OTHER; note = 2'-O-methyl modification
  modified_base 97: mod_base = OTHER; note = 2'-O-methyl modification and phosphorothioate bond
  modified_base 98: mod_base = OTHER; note = 2'-O-methyl modification and phosphorothioate bond
  modified_base 99: mod_base = OTHER; note = 2'-O-methyl modification and phosphorothioate bond
  modified_base 100: mod_base = OTHER; note = 2'-O-methyl modification
  source 1..100: mol_type = other RNA
ggattgcgtatgggacacaagttttagagctagaaatagcaagttaaaataaggctagtccgttatcaacttgaaaaagtggcaccgagtcggtgctttt

SEQ ID NO: 604 - RNA, 100 nt, synthetic construct
  misc_feature 1..100: note = Synthetic
  modified_base 1: mod_base = OTHER; note = 2'-O-methyl modification and phosphorothioate bond
  modified_base 2: mod_base = OTHER; note = 2'-O-methyl modification and phosphorothioate bond
  modified_base 3: mod_base = OTHER; note = 2'-O-methyl modification and phosphorothioate bond
  modified_base 29: mod_base = OTHER; note = 2'-O-methyl modification
  modified_base 30: mod_base = OTHER; note = 2'-O-methyl modification
  modified_base 31: mod_base = OTHER; note = 2'-O-methyl modification
  modified_base 32: mod_base = OTHER; note = 2'-O-methyl modification
  modified_base 33: mod_base = OTHER; note = 2'-O-methyl modification
  modified_base 34: mod_base = OTHER; note = 2'-O-methyl modification
  modified_base 35: mod_base = OTHER; note = 2'-O-methyl modification
  modified_base 36: mod_base = OTHER; note = 2'-O-methyl modification
  modified_base 37: mod_base = OTHER; note = 2'-O-methyl modification
  modified_base 38: mod_base = OTHER; note = 2'-O-methyl modification
  modified_base 39: mod_base = OTHER; note = 2'-O-methyl modification
  modified_base 40: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification
  modified_base 78: mod_base = OTHER; note = 2'-O-methyl modification
  modified_base 79: mod_base = OTHER; note = 2'-O-methyl modification
  modified_base 80: mod_base = OTHER; note = 2'-O-methyl modification
  modified_base 81: mod_base = OTHER; note = 2'-O-methyl modification
  modified_base 82: mod_base = OTHER; note = 2'-O-methyl modification
  modified_base 83: mod_base = OTHER; note = 2'-O-methyl modification
  modified_base 84: mod_base = OTHER; note = 2'-O-methyl modification
  modified_base 85: mod_base = OTHER; note = 2'-O-methyl modification
  modified_base 86: mod_base = OTHER; note = 2'-O-methyl modification
  modified_base 87: mod_base = OTHER; note = 2'-O-methyl modification
  modified_base 88: mod_base = OTHER; note = 2'-O-methyl modification
  modified_base 89: mod_base = OTHER; note = 2'-O-methyl modification
  modified_base 90: mod_base = OTHER; note = 2'-O-methyl modification
  modified_base 91: mod_base = OTHER; note = 2'-O-methyl modification
  modified_base 92: mod_base = OTHER; note = 2'-O-methyl modification
  modified_base 93: mod_base = OTHER; note = 2'-O-methyl modification
  modified_base 94: mod_base = OTHER; note = 2'-O-methyl modification
  modified_base 95: mod_base = OTHER; note = 2'-O-methyl modification
  modified_base 96: mod_base = OTHER; note = 2'-O-methyl modification
  modified_base 97: mod_base = OTHER; note = 2'-O-methyl modification and phosphorothioate bond
  modified_base 98: mod_base = OTHER; note = 2'-O-methyl modification and phosphorothioate bond
  modified_base 99: mod_base = OTHER; note = 2'-O-methyl modification and phosphorothioate bond
  modified_base 100: mod_base = OTHER; note = 2'-O-methyl modification
  source 1..100: mol_type = other RNA
tacccgggagttgactttgggttttagagctagaaatagcaagttaaaataaggctagtccgttatcaacttgaaaaagtggcaccgagtcggtgctttt

SEQ ID NO: 605 - RNA, 100 nt, synthetic construct
  misc_feature 1..100: note = Synthetic
  modified_base 1: mod_base = OTHER; note = 2'-O-methyl modification and phosphorothioate bond
  modified_base 2: mod_base = OTHER; note = 2'-O-methyl modification and phosphorothioate bond
  modified_base 3: mod_base = OTHER; note = 2'-O-methyl modification and phosphorothioate bond
  modified_base 29: mod_base = OTHER; note = 2'-O-methyl modification
  modified_base 30: mod_base = OTHER; note = 2'-O-methyl modification
  modified_base 31: mod_base = OTHER; note = 2'-O-methyl modification
  modified_base 32: mod_base = OTHER; note = 2'-O-methyl modification
  modified_base 33: mod_base = OTHER; note = 2'-O-methyl modification
  modified_base 34: mod_base = OTHER; note = 2'-O-methyl modification
  modified_base 35: mod_base = OTHER; note = 2'-O-methyl modification
  modified_base 36: mod_base = OTHER; note = 2'-O-methyl modification
  modified_base 37: mod_base = OTHER; note = 2'-O-methyl modification
  modified_base 38: mod_base = OTHER; note = 2'-O-methyl modification
  modified_base 39: mod_base = OTHER; note = 2'-O-methyl modification
  modified_base 40: mod_base = OTHER; note = 2'-O-methyl modification
  modified_base 69: mod_base = OTHER; note = 2'-O-methyl modification
  modified_base 70: mod_base = OTHER; note = 2'-O-methyl modification
  modified_base 71: mod_base = OTHER; note = 2'-O-methyl modification
  modified_base 72: mod_base = OTHER; note = 2'-O-methyl modification
  modified_base 73: mod_base = OTHER; note = 2'-O-methyl modification
  modified_base 74: mod_base = OTHER; note = 2'-O-methyl modification
  modified_base 75: mod_base = OTHER; note = 2'-O-methyl modification
  modified_base 76: mod_base = OTHER; note = 2'-O-methyl modification
  modified_base 77: mod_base = OTHER; note = 2'-O-methyl modification
  modified_base 78: mod_base = OTHER; note = 2'-O-methyl modification
  modified_base 79: mod_base = OTHER; note = 2'-O-methyl modification
  modified_base 80: mod_base = OTHER; note = 2'-O-methyl modification
  modified_base 81: mod_base = OTHER; note = 2'-O-methyl modification
  modified_base 82: mod_base = OTHER; note = 2'-O-methyl modification
  modified_base 83: mod_base = OTHER; note = 2'-O-methyl modification
  modified_base 84: mod_base = OTHER; note = 2'-O-methyl modification
  modified_base 85: mod_base = OTHER; note = 2'-O-methyl modification
  modified_base 86: mod_base = OTHER; note = 2'-O-methyl modification
  modified_base 87: mod_base = OTHER; note = 2'-O-methyl modification
  modified_base 88: mod_base = OTHER; note = 2'-O-methyl modification
  modified_base 89: mod_base = OTHER; note = 2'-O-methyl modification
  modified_base 90: mod_base = OTHER; note = 2'-O-methyl modification
  modified_base 91: mod_base = OTHER; note = 2'-O-methyl modification
  modified_base 92: mod_base = OTHER; note = 2'-O-methyl modification
  modified_base 93: mod_base = OTHER; note = 2'-O-methyl modification
  modified_base 94: mod_base = OTHER; note = 2'-O-methyl modification
  modified_base 95: mod_base = OTHER; note = 2'-O-methyl modification
  modified_base 96: mod_base = OTHER; note = 2'-O-methyl modification
  modified_base 97: mod_base = OTHER; note = 2'-O-methyl modification and phosphorothioate bond
  modified_base 98: mod_base = OTHER; note = 2'-O-methyl modification and phosphorothioate bond
  modified_base 99: mod_base = OTHER; note = 2'-O-methyl modification and phosphorothioate bond
  modified_base 100: mod_base = OTHER; note = 2'-O-methyl modification
  source 1..100: mol_type = other RNA
tttactcccagaagactgtagttttagagctagaaatagcaagttaaaataaggctagtccgttatcaacttgaaaaagtggcaccgagtcggtgctttt

What is claimed is:

1. A composition comprising:

(a) a single guide RNA (sgRNA) comprising, in 5' to 3' order:

(i) a guide sequence that is 20 to 25 nucleotides in length and comprises the nucleotide sequence GGAUUGCGUAUGGGACACAA (SEQ ID NO: 15); and (ii) a nucleotide sequence comprising GUUUUA-GAGCUA-GAAAUAGCAAGUUAAAAUAAGGCUAGU-CCGUUAUCAAC UUGAAAAAGUGGCACCGAGUCGGUGC-UUUU (SEQ ID NO:171); and (b) a messenger RNA (mRNA) comprising a sequence encoding a *Streptococcus pyogenes* Cas9 (SpyCas9) protein.

2. The composition of claim 1, wherein the sgRNA comprises at least one chemical modification of a sugar group or a phosphate group of a nucleotide within the sequence GGAUUGCGUAUGGGACACAA (SEQ ID NO:15) or the sequence GUUUUAGAGCUA-GAAAUAGCAAGUUAAAAUAAGGCUAGU-CCGUUAUCAACUUG AAAAAGUGGCACCGAGUCG-GUGCUUUU (SEQ ID NO:171).

3. The composition of claim 2, wherein the at least one chemical modification is (a) a replacement of the 2' hydroxyl on the sugar group with 2'-O-methyl (a 2'-O-Me modification) and/or (b) the substitution of a nonbridging phosphate oxygen of the phosphate group with S— (a phosphorothioate (PS) bond).

4. The composition of claim 3, wherein the sgRNA comprises a 2'-O-Me modification at one or more of the first three nucleotides at the 5' terminus of SEQ ID NO: 15 and/or at one or more of the last three nucleotides at the 3' end of SEQ ID NO: 171.

5. The composition of claim 3, wherein the sgRNA comprises PS bonds between two or more of the first four nucleotides at the 5' terminus of SEQ ID NO: 15 and/or between three or more of the last four nucleotides at the 3' terminus of SEQ ID NO: 171.

6. The composition of claim 2, wherein the sgRNA comprises GUUUUAGAmGmCmUmAmGmAmAmAmU-mAmGmCAAGUUAAAAUAAGGCUAGUCCG UUAU-CAmAmCmUmUmGmAmAmAmAmAmG-mUmGmGmCmAmCmCmGmAmGmUmCm GmGmUmGmCmU*mU*mU*mU (SEQ ID NO: 405), wherein a * denotes a PS bond and "mA," "mC," "mU," and "mG" each denote a nucleotide containing a 2'-O-Me modification.

7. The composition of claim 6, wherein the sgRNA comprises mG*mG*mA*UUGCGUAUGGGACACAAGUUUUAGA mGmCmUmAmGmAmAmAmUmAm GmCAAGUUAAAAUAAGGCUAGUCCGUUAUCAmA-mCmUmUmGmAmAmAmAmAmGm UmGmGmCmAm-CmCmGmAmGmUmCmGmGmUmGm CmU*mU*mU*mU (SEQ ID NO: 603, wherein a * denotes a PS bond and "mA," "mC," "mU," and "mG" each denote a nucleotide containing a 2'-O-Me modification.

8. The composition of claim 7, wherein the sgRNA consists of mG*mG*mA*UUGCGUAUGGGACACAAGUUUUAGA mGmCmUmAmGmAmAmAmUmA mGmCAAGUUAAAAUAAGGCUAGUCCGUUAUCA-mAmCmUmUmGmAmAmAmAmAm GmUmGmGmC-mAmCmCmGmAmGmUmCmGmGmUm GmCmU*mU*mU*mU (SEQ ID NO: 603), wherein a * denotes a PS bond and "mA," "mC," "mU," and "mG" each denote a nucleotide containing a 2'-O-Me modification.

9. The composition of claim 1, wherein the guide sequence is 20 nucleotides in length.

10. The composition of claim 1, wherein the composition further comprises a lipid nanoparticle (LNP) comprising an ionizable lipid.

11. The composition of claim 10, wherein the ionizable lipid is (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate.

12. The composition of claim 10, wherein the LNP further comprises a helper lipid, a neutral lipid, and a stealth lipid.

13. The composition of claim 10, wherein the LNP comprises:

(i) (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy) carbonyl)oxy)methyl)propyl (9Z,12Z)-octadeca-9,12-dienoate;

(ii) disteroylphosphatidylcholine;

(iii) cholesterol; and (iv) PEG2k-DMG.

14. The composition of claim 1, wherein the mRNA encoding the SpyCas9 protein comprises, at the 5' end, an anti-reverse cap analog comprising a 7-methylguanine 3'-methoxy-5'-triphosphate linked to the 5' position of a guanine ribonucleotide and, at the 3' end, at least 20 adenine nucleotides (a poly-A tail).

15. The composition of claim 1, wherein the mRNA encoding the SpyCas9 protein comprises the RNA sequence of SEQ ID NO:516.

16. The composition of claim 1, wherein the mRNA encoding the SpyCas9 protein comprises a modified uridine at one, a plurality of, or all of the positions occupied by uridine in the mRNA.

17. The composition of claim 16, wherein the modified uridine is N1-methylpseudouridine.

18. The composition of claim 1, wherein the composition comprises:

(a) a single guide RNA (sgRNA) comprising mG*mG*mA*UUGCGUAUGGGACACAAGUUUU AGAmGmCmUmAmGmAmAmAmUmA mGmCAAGUUAAAAUAAGGCUAGUCCGUUAU-CAmAmCmUmUmGmAmAmAmAmAm GmUmGmGmCmAmCmCmGmAmGmUmCmGm GmUmGmCmU*mU*mU*mU (SEQ ID NO: 603), wherein a * denotes a PS bond and "mA," "mC," "mU," and "mG" each denote a nucleotide containing a 2'-O-Me modification;

(b) the mRNA comprising a sequence encoding the SpyCas9 protein; and (c) a lipid nanoparticle comprising an ionizable lipid.

19. The composition of claim 18, wherein the sgRNA consists of mG*mG*mA*UUGCGUAUGGGACACAAGUUUUAGA mGmCmUmAmGmAmAmAmUmA mGmCAAGUUAAAAUAAGGCUAGUCCGUUAUCA-mAmCmUmUmGmAmAmAmAmAm GmUmGmGmC-mAmCmCmGmAmGmUmCmGmGmUm GmCmU*mU*mU*mU (SEQ ID NO: 603).

20. The composition of claim 18, wherein the mRNA comprising a sequence encoding the SpyCas9 protein comprises the RNA sequence of SEQ ID NO:516.

21. The composition of claim 20, wherein the mRNA comprising a sequence encoding the SpyCas9 protein comprises N1-methylpseudouridine at one, a plurality of, or all of the positions occupied by uridine in the mRNA.

22. The composition of claim 18, wherein the wherein the ionizable lipid is (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate.

23. The composition of claim 18, wherein the LNP further comprises a helper lipid, a neutral lipid, and a stealth lipid.

24. The composition of claim 18, wherein the LNP comprises:

(i) (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate;

(ii) disteroylphosphatidylcholine;

(iii) cholesterol; and (iv) PEG2k-DMG.

25. The composition of claim 19, wherein the mRNA comprising a sequence encoding the SpyCas9 protein comprises the RNA sequence of SEQ ID NO:516.

26. The composition of claim 25, wherein the mRNA comprising a sequence encoding the SpyCas9 protein comprises N1-methylpseudouridine at one, a plurality of, or all of the positions occupied by uridine in the mRNA.

27. The composition of claim 19, wherein the ionizable lipid is (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate.

28. The composition of claim 19, wherein the LNP further comprises a helper lipid, a neutral lipid, and a stealth lipid.

29. The composition of claim 19, wherein the LNP comprises:

(i) (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate;

(ii) disteroylphosphatidylcholine;

(iii) cholesterol; and (iv) PEG2k-DMG.

30. The composition of claim 19, wherein the mRNA comprising a sequence encoding the SpyCas9 protein comprises the RNA sequence of SEQ ID NO: 516 and N1-methylpseudouridine occupies one, a plurality of, or all of the positions occupied by uridine in SEQ ID NO: 516; and the LNP comprises (i) (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate;

(ii) disteroylphosphatidylcholine;

(iii) cholesterol; and (iv) PEG2k-DMG.

* * * * *